United States Patent
Mascarell et al.

(10) Patent No.: US 11,015,221 B2
(45) Date of Patent: May 25, 2021

(54) MARKERS OF IMMUNE RESPONSE

(71) Applicant: STALLERGENES, Antony (FR)

(72) Inventors: Laurent Mascarell, Paris (FR); Claire Gueguen, Reading (GB); Emmanuel Nony, Antony (FR); Philippe Moingeon, Verrieres le Buisson (FR); Véronique Bodo, Palaiseau (FR)

(73) Assignee: STALLERGENES, Antony (FR)

( * ) Notice: Subject to any disclaimer, the term of this patent is extended or adjusted under 35 U.S.C. 154(b) by 216 days.

(21) Appl. No.: 15/521,680

(22) PCT Filed: Oct. 29, 2015

(86) PCT No.: PCT/EP2015/075174
§ 371 (c)(1),
(2) Date: Apr. 25, 2017

(87) PCT Pub. No.: WO2016/066770
PCT Pub. Date: May 6, 2016

(65) Prior Publication Data
US 2017/0233816 A1    Aug. 17, 2017

(30) Foreign Application Priority Data
Oct. 29, 2014    (EP) .................................... 14306733

(51) Int. Cl.
*C12Q 1/6883*    (2018.01)
*C12Q 1/6886*    (2018.01)
*G01N 33/50*    (2006.01)
*C12Q 1/6881*    (2018.01)

(52) U.S. Cl.
CPC ......... *C12Q 1/6883* (2013.01); *C12Q 1/6881* (2013.01); *C12Q 1/6886* (2013.01); *G01N 33/505* (2013.01); *G01N 33/5023* (2013.01); *C12Q 2600/106* (2013.01); *C12Q 2600/158* (2013.01)

(58) Field of Classification Search
None
See application file for complete search history.

(56) References Cited

U.S. PATENT DOCUMENTS 7,645,575 B2 * 1/2010 Wohlgemuth ....... C12Q 1/6883
435/6.14
2003/0134283 A1    7/2003 Peterson

FOREIGN PATENT DOCUMENTS

WO    2013034569 A1    3/2013

OTHER PUBLICATIONS

Esnault S, Kelly EA, Schwantes EA, Liu LY, DeLain LP, et al. (2013) Identification of Genes Expressed by Human Airway Eosinophils after an in Vivo Allergen Challenge. PLoS One 8(7): e67560. (Year: 2013).*
NCBI Platform GPL17077. Agilent-039494 SurePrint G3 Human GE v2 8x60K Microarray 039381. two pages. (Year: 2013).*
Masuda et al., 2003, J. Rheum. vol. 30: 1911-1917.*
Chauhan et al., 2015, J. Biol. Chem. vol. 290: 5127-5140.*
Kowal et al., 2012, Scan. J. Immunol. pp. 531-539.*
Zhong et al., 2012, Blood, vol. 120: 3326-3335.*
Huang et al., 2012, Gene, vol. 504: 284-287.*
Sugita et al., 1999, Clin. Exp Immunol. vol. 117: 350-354.*
Watanabe et al., 1998, Clin. Immunol. vol. 88: 91-95.*
Moniuszko et al., 2007, Folia Histo. et Cyto: vol. 45: 181-189.*
Hatjiharissi et al., 2007, Blood vol. 110: 2561-2564.*
Bournazos et al., Immunity vol. 47: 224-233.*
Geo Accession viewer for GF211, 2019, pp. 1-57.*
Lynch, 2000, J. Leuk. Biol. vol. 67: 279-284.*
Dreschler et al., 2011, J. Aller. Clin. Immunol. vol. 127: 487-94.*
Kayserova et al., 2011, Scan J. Immunol. pp. 305-312.*
Liu et al., 2005, Clin. Exp. Allergy vol. 35: 1581-1590.*
Torres-Aguilar et al., 2010, J. Immunol. vol. vol. 184: 1765-1775.*
Hirsch et al., 2015: Immunotargets and Therapy vol. 4: 1-11.*
Fick et al., 2000, Immunopharm. vol. 48: 307-310.*
Liu et al., 2000, Blood, vol. 95: 2482-2483.*
Yerkovich et all., 2009, J Allergy Clin Immunol. vol. 123: 209-216.*
Lundberg et al., Sep. 2014, Allergy, vol. 69: p. 162.*
Zimmer et al.,"A regulatory dendritic cell signature correlates with the clinical efficacy of allergen-specific sublingual immunotherapy", Journal of Allergy and Clinical Immunology, pp. 1020-1030, vol. 129, No. 4 (Feb. 2012).
J. Gomez et al.,"Differential up-regulation of HLA-DM, invariant chain, and CD83 on myeloid and plasmacytoid dendritic cells from peripheral blood" Tissue Antigens, pp. 149-157, vol. 63, No. 2 (Feb. 2004).
Lonial et al.,"Regulation of alloimmune responses by dendritic cell subsets", Experimental Hematology, pp. 1309-1317, vol. 36, No. 10 (Oct. 2008).
Arpinati et al.,"Use of anti-BDCA-2 antibody for detection of dendritic cells type-2 (DC2) in allogeneic hematopoietic stem cell transplantation", Bone Marrow Transplantation, pp. 887-891, vol. 29, No. 11 (Jun. 2002).
Querec et al.,"Systems biology approach predicts immunogenicity of the yellow fever vaccine in humans", Nature Immunology, pp. 116-125, vol. 10, No. 1 (Nov. 2008).
De Baey Annegret et al.,"Phenotype and function of human dendritic cells derived from M-DC8+ monocytes" European Journal of Immunology, pp. 1646-1655, vol. 31, No. 6 (Jun. 2001).

(Continued)

*Primary Examiner* — Amy E Juedes
(74) *Attorney, Agent, or Firm* — Browdy and Neimark, PLLC

(57) ABSTRACT

The present invention concerns methods for determining if a dendritic cell is a type 2 dendritic cell or a tolerogenic dendritic cell, methods for determining if a patient undergoing immunotherapy, and/or who has been administered with a vaccine, is developing an immune response oriented either towards a regulatory T cell response or towards an effector type 2 cell response, and methods of determining response to immunotherapy.

3 Claims, 25 Drawing Sheets
Specification includes a Sequence Listing.

(56) References Cited

OTHER PUBLICATIONS

Piccioli et al.,"Functional specialization of human circulating CD16 and CD1c myeloid dendritic-cell subsets" Blood, pp. 5371-5379, vol. 109, No. 12 (Jun. 2007).
Mellor et al.,"A critical review of the role of Fc gamma receptor polymorphisms in the response to monoclonal antibodies in cancer", Journal of Hematology & Oncology, pp. 1756-8722, vol. 6, No. 1 (Jan. 2013).
Gordon et al.,"Regulatory Dendritic Cells for Immunotherapy in Immunologic Disease", Frontiers in Immunology, pp. 1-19, vol. 5 (Jan. 2014).
Adkis et al.,"Mechanisms of allergen-specific immunotherapy: Multiple suppressor factors at work in immune tolerance to allergens" J Allergy Clin Immunol, pp. 621-631 (Mar. 2014).
Moingeon et al.,"Immune mechanisms of allergen-specific sublingual immunotherapy", Allergy, pp. 151-165, (Sep. 2005).
Jain et al, "Cutting Edge: Dab2 Is F0XP3 Target Gene Required for Regulatory T Cell Function", The Journal of Immunology, pp. 4192-4196, vol. 183, No. 7 (Sep. 2009).
Ahmed et al.,"Dab2, a negative regulator of DC irmunogenicity, is an attractive molecular target for DC-based inmunotherapy" Oncoimmunology, pp. 1-15, vol. 4, No. 1 (Jan. 2015).
Sallusto et al.,"Efficient Presentation of Soluble Antigen by Cultured Human Dendritic Cells is Maintained by Granulocyte/Macrophage Colony-stimulating Factor Plus luterleukin 4 and Downregulated by Tumor Necrosis Factor (sigma)", J. Exp. Med , pp. 1109-1118, vol. 179 (Apr. 1994).

Scadding et al.,"Sublingual grass pollen immunotherapy is associated with increases in sublingual Foxp3-expressing cells and elevated allergen-specific immunog lobulin G4, immunoglobulin A and serum inhibitory activity for immunoglobulin E-facilitated allergen binding to B cells" Clinical & Experimental Allergy, pp. 598-606, vol. 40 (Dec. 2009).
Van Overtvelt et al.,"Changes in basophil activation during grass-pollen sublingual immunotherapy do not correlate with clinical efficacy" Allergy, pp. 1530-1537, 66 (Jul. 2011).
Zimmer et al.,"Identification of a New Phenotype of Tolerogenic Human Dendritic Cells Induced by Fungal Proteases from Aspergillus oryzae", J Immunol., pp. 3966-3976 (Mar. 2011).
Bohle et al.,"Sublingual immunotherapy induces IL-10—producing T regulatory cells, allergen-specific T-cell tolerance, and immune deviation", J Allergy Clin Immunol., pp. 707-713, vol. 120, No. 3 (Aug. 2007).
Horak et al.,"Early onset of action of a 5-grass-pollen 300-IR sublingual immunotherapy tablet evaluated in an allergen challenge chamber" J Allergy Clin Immunol., pp. 471-477 (Sep. 2009).
Kasturi et al.,"Programming the magnitude and persistence of antibody responses with innate immunity", Nature, pp. 543-547, vol. 470, No. 7335 (Feb. 2011).
Florin-Dan et al."Molecular biomarkers for grass pollen immunotherapy" World Journal of Methodology, pp. 26-45 , vol. 1, No. 1 (Mar. 2014).
Gueguen et al.,"Changes in markers associated with dendritic cells driving the differentiation of either TH2 cells or regulatory T cells correlate with clinical benefit during allergen immunotherapy" Journal of Allergy and Clinical Immunology, pp. 545-558 vol. 137, No. 2 (Oct. 2015).

\* cited by examiner

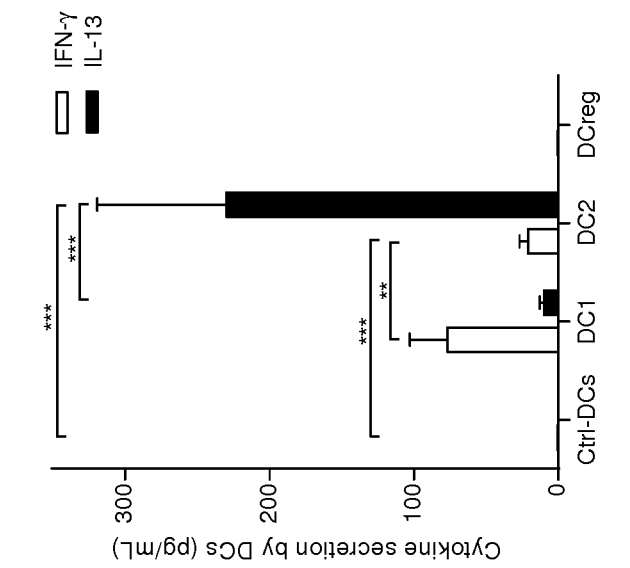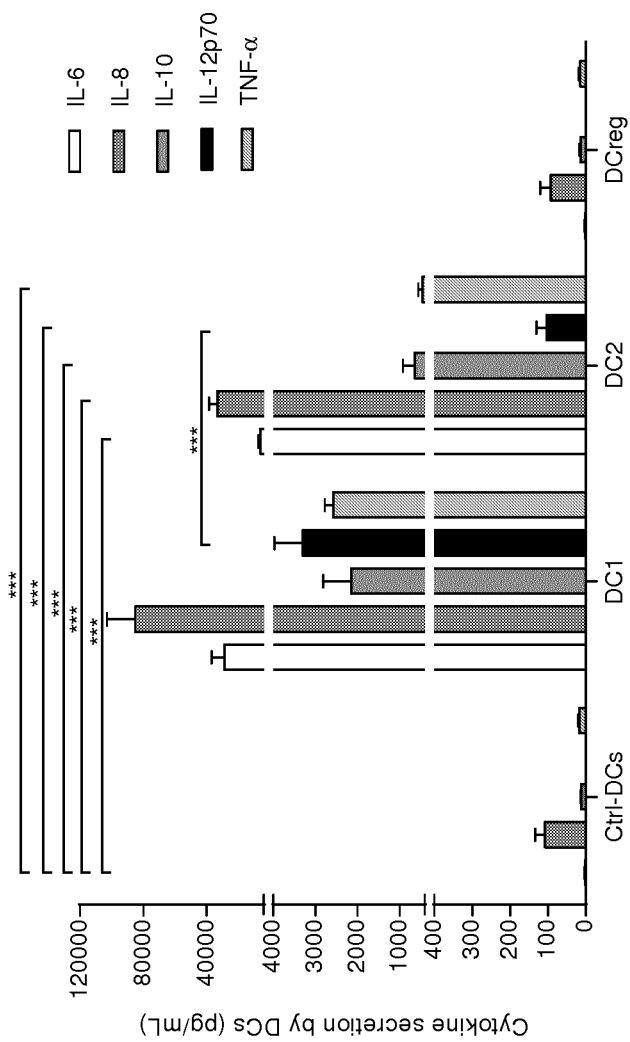
FIG.2

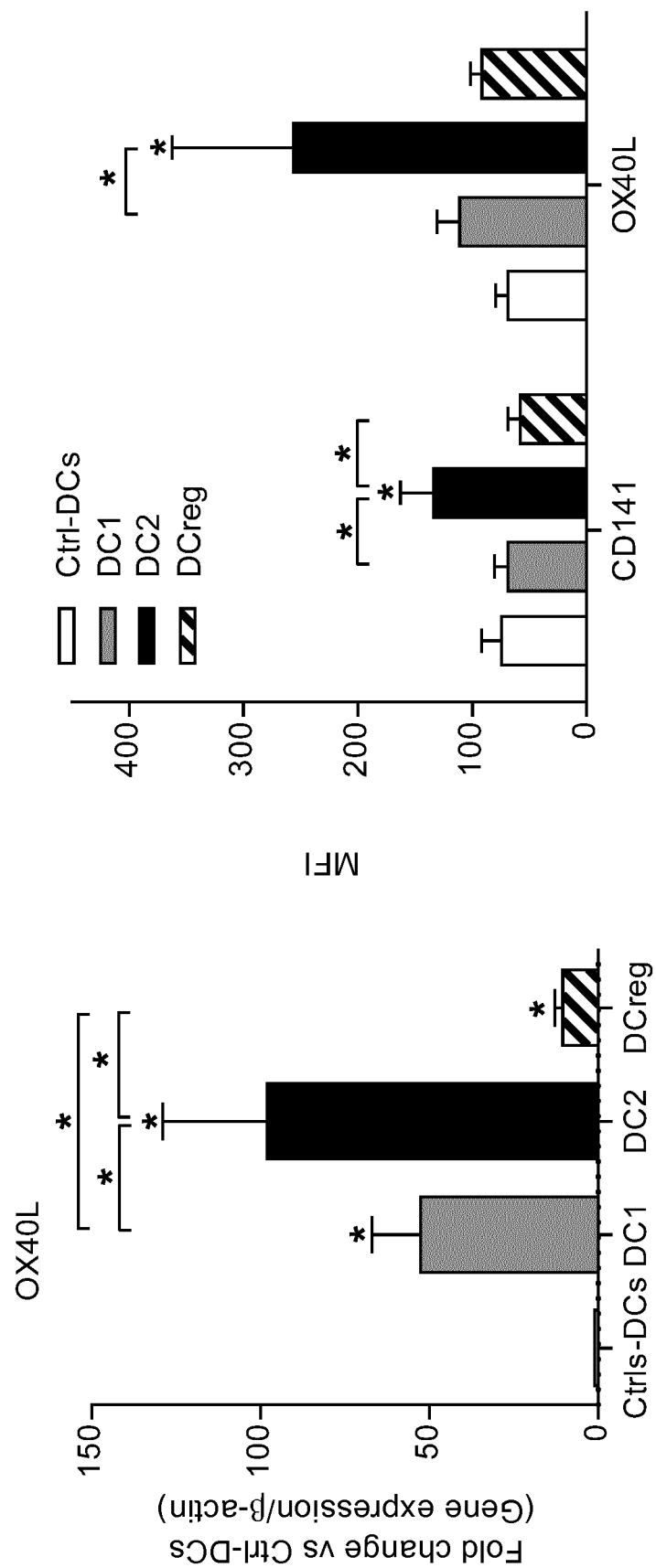

MARKERS OF IMMUNE RESPONSE

The present invention concerns markers of different subsets of dendritic cells, and the use thereof to assess immune response in an individual.

Allergen immunotherapy (AIT) is an efficacious therapy for type I respiratory allergies, which reorients CD4+ T cells from a Th2 towards a Th1/Treg pattern (Moingeon et al. (2006) *Allergy* 61:151-165; Bohle et al. (2007) *J. Allergy Clin. Immunol.* 120:707-713; Akdis et al. (2014) *J. Allergy Clin Immunol.* 3:621-631). However, surrogate biomarkers which could be used as follow-up read-outs of AIT efficacy remain to be fully established.

Several biological parameters were previously evaluated during AIT in order to identify such markers of clinical efficacy: generation of Treg cells, changes in blocking IgG$_4$ antibody responses, down-regulation of Th2 response, and decrease of basophils activity. These markers were identified in open clinical studies with small cohorts and without established links with clinical efficacy (Bohle et al. (2007) *J. Allergy Clin. Immunol.* 120:707-713; Scadding et al. (2010) *Clinical & Experimental Allergy* 40:598-606). In recent studies, the inventors took advantage of a double-blind, placebo-controlled study conducted in a pollen chamber in a cohort of 82 grass pollen allergic patients to test allergen reactivity of peripheral blood basophils, changes in phenotype and in cytokine secretion in grass pollen-specific CD4+ T cells, and antibody responses after AIT. However, none of those parameters was confirmed to be a marker for the early onset of efficacy of AIT (Van Overtvelt et al. (2011) *Allergy* 66:1530-1537).

Accordingly, there is still an important need of biochemical markers indicative of the immune response developed by a subject further to an immunotherapy.

Dendritic cells (DCs) are key players to assess proper polarization or reorientation of T helper responses (Th1, Th2 and Treg induced by DC1, DC2 and DCreg, respectively) and recent findings revealed a growing interest in characterizing molecular markers from monocyte-derived dendritic cells (MoDCs) which persist in patient's blood following vaccination or immunotherapy (Querec et al. (2009) *Nat. Immunol.* 10:116-125; Kasturi et al. (2011) *Nature* 470:543-547; Zimmer et al. (2012) *J. Allergy Clin. Immunol.* 129:1020-1030).

The inventors previously showed that the increased expression of the DCreg markers C1Q and Stabilin-1 in peripheral blood mononuclear cells (PBMCs) of grass pollen allergic patients correlated with clinical efficacy of AIT (Zimmer et al. (2012) *J. Allergy Clin. Immunol.* 129:1020-1030; International application WO 2013/034569). However, whereas down-regulation of Th2 response is known to be a marker of the clinical efficacy of AIT, no alteration of DC2 markers, which could be useful to predict the efficacy of AIT, has been identified yet.

DESCRIPTION OF THE INVENTION

The present invention results from the identification by the inventors of molecular signatures of DC2 and DCreg, using optimal culture conditions capable of inducing the differentiation of immature MoDCs towards DCreg and DC2, which promoted respectively Treg and Th2 responses. Using cDNA microarrays together with quantitative proteomics (label-free mass spectrometry), the inventors here identified novel markers specific for DC2 and DCreg and showed that these markers correlate with the clinical efficacy of AIT as soon as 2 months after the beginning of therapy and are therefore useful biomarkers of a successful clinical response in allergic patients undergoing sublingual AIT.

Therefore, in a first aspect, the present invention concerns a method, preferably an in vitro method, for determining if a patient is developing an immune response oriented either towards a regulatory T cell (or Treg) response or towards a Th2 response, which method comprises the step a) of determining the level of expression of at least one, preferably 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47 or 48, marker protein(s) selected from the group consisting of DAB2, FcγRIIa, FcγRIIIa, FTL, PECAM1, SLCO2B1, GATA3, RIPK4, CALCA, CREM, FMOD, HCRTR1, ILDR2, ITK, PADI2, PDE4D, PNOC, RGS9, ROR1, SIX2, SYT4, THBS1, TRIM9, ADAM8, CYTIP, NRP2, SEMA7A, TBC1D13, FcεRIG, MCTP1, SIGLEC5, C3AR1, CD163, IVNS1ABP, CD300LF, CFH, CSGALNACT1, P2RY14, ZBTB16, FcγRIIB, CYP1B1, DPYD, GCLC, LRRC25, NUDT16, PDCD4, RNASE6 and RNASET2, or of an mRNA thereof, in a biological sample from the patient.

In the first aspect of the invention, the patient may be a patient suffering from a disease, for instance an infectious disease, a tumor, an autoimmune disease, an allergy, or a patient who has been grafted. Further, the patient may be treated or not against said disease or against graft rejection.

In a preferred embodiment, the patient is undergoing immunotherapy and/or has been administered with a vaccine.

If the method is carried out on a biological sample obtained from a non treated patient, it will allow assessing which type of T cell response the patient suffering from a disease is developing.

Preferably, the method further comprises the steps of:
b) comparing the level of expression of the at least one marker protein, or of an mRNA thereof, measured in step a) with a control, and
c) based on the comparison of step b), determining if the patient is developing an immune response oriented either towards a regulatory T cell response or towards a Th2 response.

When the patient is not treated, the control may consist of immature and/or polarized dendritic cells, more preferably immature dendritic cells. Alternatively, the control may be a biological sample from a healthy donor, in particular of the same nature than that of the biological sample to be tested (e.g. peripheral blood when the biological sample to be tested is peripheral blood, etc).

When the patient is treated, the control may consist of a biological sample from the patient obtained before the beginning of the treatment, in particular before said patient undergoes immunotherapy and/or is administered with a vaccine, said biological sample being in particular of the same nature than that of the biological sample to be tested.

Whatever the type of patients (i.e. treated or not treated), preferably when the above recited controls are used, the determination step c) of the method is as follows:

an increased level of expression (in particular compared to the above recited controls) of at least one marker protein selected from the group consisting of DAB2, FcγRIIA, FcγRIIIa, FTL, PECAM1, SLCO2B1, C3AR1, CD163, CD300LF, CFH, CSGALNACT1, P2RY14, ZBTB16, FcγRIIB, CYP1B1, DPYD, GCLC, IVNS1ABP, LRRC25, NUDT16, PDCD4, RNASE6, RNASET2, FcεRIG, MCTP1 and SIGLEC5, or of an mRNA thereof, indicates that the patient is developing an immune response oriented towards a regulatory T cell response, and/or an increased level of expression (in particular compared to the above recited controls) of at least one marker protein selected from the group consisting of GATA3, RIPK4, CALCA, CREM, FMOD, HCRTR1, ILDR2, ITK, PADI2, PDE4D, PNOC, RGS9, ROR1, SIX2, SYT4, THBS1, TRIM9, ADAM8, CYTIP, NRP2, SEMA7A and TBC1D13, or of an mRNA thereof, and/or a decreased level of expression (in particular compared to the above recited controls) of at least one marker protein selected from the group consisting of FcγRIIa, FcγRIIIa, FcεRIG, MCTP1, SIGLEC5, C3AR1, CD163 and IVNS1ABP, or of an mRNA thereof, indicates that the patient is developing an immune response oriented towards a Th2 response.

Preferably, the at least one marker protein the level of expression of which is determined in step a) is selected from the group consisting of CALCA, PNOC, ROR1 and SYT4. Still preferably, the at least one marker protein the level of expression of which is determined in step a) is selected from the group consisting of CREM, FMOD, GATA3, HCRTR1, ILDR2, ITK, PADI2, PDE4D, RGS9, RIPK4, SIX2, THBS1 and TRIM9. Still preferably, the at least one marker protein the level of expression of which is determined in step a) is selected from the group consisting of FcγRIIa, FcγRIIIa, FcεRIG, MCTP1, SIGLEC5, C3AR1, CD163 and IVNS1ABP.

Preferably, the at least one marker protein the level of expression of which is determined in step a) is selected from the group consisting of C3AR1, CD163, CD300LF, CHF, CSGALNACT1, FcγRIIa, FcγRIIb, P2RY14 and ZBTB16. Still preferably, the at least one marker protein the level of expression of which is determined in step a) is selected from the group consisting of C3AR1, CD163, CD300LF, CHF, FcγRIIa, FcγRIIb and P2RY14. Still preferably, the at least one marker protein the level of expression of which is determined in step a) is selected from the group consisting of CYP1B1, DAB2, DPYD, FTL, GCLC, IVNS1ABP, LRRC25, NUDT16, PDCD4, PECAM1, RNASE6, RNASET2, and SLCO2B1. Still preferably, the at least one marker protein the level of expression of which is determined in step a) is selected from the group consisting of CD300LF, FcγRIIIa, FcγRIIa, PECAM1.

An increased level of expression (in particular compared to the above recited controls) of at least one marker protein selected from the group consisting of DAB2, FcγRIIA, FcγRIIIa, FTL, PECAM1, SLCO2B1, C3AR1, CD163, CD300LF, CFH, CSGALNACT1, P2RY14, ZBTB16, FcγRIIB, CYP1B1, DPYD, GCLC, IVNS1ABP, LRRC25, NUDT16, PDCD4, RNASE6, RNASET2, FcεRIG, MCTP1 and SIGLEC5, or of an mRNA thereof, also identifies the patient as likely to be a responder to the immunotherapy and/or vaccine, when the immunotherapy and/or vaccine aims at treating an autoimmune disease or an allergy.

A decreased level of expression (in particular compared to the above recited controls) of at least one marker protein selected from the group consisting of GATA3, RIPK4, CALCA, CREM, FMOD, HCRTR1, ILDR2, ITK, PADI2, PDE4D, PNOC, RGS9, ROR1, SIX2, SYT4, THBS1, TRIM9, ADAM8, CYTIP, NRP2, SEMA7A and TBC1D13, or of an mRNA thereof, also identifies the patient as likely to be a responder to the immunotherapy and/or vaccine, when the immunotherapy and/or vaccine aims at treating an autoimmune disease or an allergy.

In a second aspect, the present invention concerns a method, preferably an in vitro method, for determining if the immune response developed by a patient, who is undergoing immunotherapy and/or has been administered with a vaccine aiming at treating an autoimmune disease or an allergy, is shifting from a Th2 response towards a tolerogenic T cell response, which method comprises the step a) of determining the level of expression of at least one, preferably 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50, marker protein(s) selected from the group consisting of DAB2, FcγRIIa, FcγRIIIa, FTL, PECAM1, SLCO2B1, CD141, GATA3, RIPK4, OX40L, CALCA, CREM, FMOD, HCRTR1, ILDR2, ITK, PADI2, PDE4D, PNOC, RGS9, ROR1, SIX2, SYT4, THBS1, TRIM9, ADAM8, CYTIP, NRP2, SEMA7A, TBC1D13, FcεRIG, MCTP1, SIGLECS, C3AR1, CD163, CD300LF, CFH, CSGALNACT1, P2RY14, ZBTB16, FcγRIIB, CYP1B1, DPYD, GCLC, IVNS1ABP, LRRC25, NUDT16, PDCD4, RNASE6 and RNASET2, or of an mRNA thereof, in a biological sample from the patient.

In this second aspect, the patient is preferably undergoing an immunotherapy that aims at treating an allergy, preferably a desensitization therapy, the immunotherapy preferably aiming at reducing (i) the immune response against the allergen(s) which trigger(s) the allergy and/or (ii) manifestation of clinical symptoms of allergy.

Preferably, the at least one protein marker the level of expression of which is determined in step a) is selected from the group consisting of DAB2, FcγRIIa, FcγRIIIa, FTL, PECAM1, SLCO2B1, CD141, GATA3, RIPK4 and OX40L. Still preferably, the at least one protein marker the level of expression of which is determined in step a) is selected from the group consisting of FcγRIIIa, FTL, SLCO2B1, CD141, GATA3 and OX40L. Still preferably, the at least one protein marker the level of expression of which is determined in step a) is selected from the group consisting of FcγRIIIa and FTL. Still preferably, the at least one protein marker the level of expression of which is determined in step a) is FcγRIIIa.

Preferably, the method further comprises the steps of:
b) comparing the level of expression of the at least one marker protein, or of an mRNA thereof, measured in step a) with a control, and
c) based on the comparison of step b), determining if the immune response developed by the patient is shifting from a Th2 response towards a tolerogenic T cell response.

In the second aspect of the invention, the control may consist of immature and/or polarized dendritic cells, more preferably immature dendritic cells. Alternatively, the control may be a biological sample from a healthy donor, in particular of the same nature than that of the biological sample to be tested (e.g. peripheral blood when the biological sample to be tested is peripheral blood, etc). The control may alternatively consist of a biological sample from the patient obtained before the beginning of the treatment, in particular before said patient undergoes immunotherapy and/or is administered with a vaccine, said biological sample being in particular of the same nature than that of the biological sample to be tested.

Preferably when the above recited controls are used, the determination step c) of the method is as follows:
an increased level of expression (in particular compared to the above recited controls) of at least one marker protein selected from the group consisting of DAB2, FcγRIIa, FcγRIIIa, FTL, PECAM1, SLCO2B1, C3AR1, CD163, CD300LF, CFH, CSGALNACT1, P2RY14, ZBTB16, FcγRIIB, CYP1B1, DPYD, GCLC, IVNS1ABP, LRRC25, NUDT16, PDCD4, RNASE6, RNASET2, FcεRIG, MCTP1 and SIGLEC5, or of an mRNA thereof, and/or a decreased level of expression (in particular compared to the above recited controls) of at least one marker protein selected from the group consisting of CD141, GATA3, RIPK4, OX40L, CALCA, CREM, FMOD, HCRTR1, ILDR2, ITK, PADI2, PDE4D, PNOC, RGS9, ROR1, SIX2, SYT4, THBS1, TRIM9, ADAM8, CYTIP, NRP2, SEMA7A and TBC1D13, or of an mRNA thereof, indicates that the immune response developed by the patient is shifting from a Th2 response towards a tolerogenic T cell response.

More preferably, when the abovementioned controls are used, the determination step c) of the method is as follows:

an increased level of expression of at least one marker protein selected from the group consisting of DAB2, FcγRIIA, FcγRIIIa, FTL, PECAM1, SLCO2B1, C3AR1, CD163, CD300LF, CFH, CSGALNACT1, P2RY14, ZBTB16, FcγRIIB, CYP1B1, DPYD, GCLC, IVNS1ABP, LRRC25, NUDT16, PDCD4, RNASE6, RNASET2, FcεRIG, MCTP1 and SIGLEC5, or of an mRNA thereof, indicates that the immune response developed by the patient is shifting from a Th2 response towards a tolerogenic T cell response.

In a particular embodiment, the level of expression of at least three protein markers more preferably of at least five protein markers, is determined in step a). Preferably, the level of expression of at least GATA3 is determined in step a). Still preferably, the level of expression of at least GATA3 and FcγRIIIa is determined in step a). Still preferably, the level of expression of at least GATA3, FcγRIIIa and FcγRIIa is determined in step a). Still preferably, the level of expression of at least GATA3, FcγRIIIa and RIPK4 is determined in step a). Still preferably, the level of expression of at least GATA3, CD141, RIPK4, C1Q (C1QA, C1QB and/or C1QC) and FcγRIIIa is determined in step a).

In a particular embodiment, the level of expression of at least three protein markers more preferably of at least five protein markers, is determined in step a).

Preferably, the level of expression of at least FcγRIIIa is determined in step a). Still preferably, the level of expression of at least FcγRIIIa and GATA3 is determined in step a). Still preferably, the level of expression of at least FcγRIIIa, GATA3 and FcγRIIa is determined in step a). Still preferably, the level of expression of at least FcγRIIIa, GATA3 and RIPK4 is determined in step a). Still preferably, the level of expression of at least FcγRIIIa, GATA3, CD141, RIPK4 and C1Q (C1QA, C1QB and/or C1QC) is determined in step a).

In another embodiment, the level of expression of at least one protein markers or mRNA thereof is combined with at least one marker protein or mRNA thereof of DCreg known in the prior art such as one described in International application WO 2013/034569.

This also identifies the patient as likely to be a responder to the immunotherapy and/or vaccine.

Accordingly, in a third aspect, the invention relates to a method, preferably an in vitro method, for determining if a patient is likely to be a responder to an immunotherapy and/or a vaccine aiming at treating an autoimmune disease or an allergy, which method comprises the step a) of determining the level of expression of at least one, preferably 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50, marker protein(s) selected from the group consisting of DAB2, FcγRIIa, FcγRIIIa, FTL, PECAM1, SLCO2B1, CD141, GATA3, RIPK4, OX40L, CALCA, CREM, FMOD, HCRTR1, ILDR2, ITK, PADI2, PDE4D, PNOC, RGS9, ROR1, SIX2, SYT4, THBS1, TRIM9, ADAM8, CYTIP, NRP2, SEMA7A, TBC1D13, FcεRIG, MCTP1, SIGLEC5, C3AR1, CD163, CD300LF, CFH, CSGALNACT1, P2RY14, ZBTB16, FcγRIIB, CYP1B1, DPYD, GCLC, IVNS1ABP, LRRC25, NUDT16, PDCD4, RNASE6 and RNASET2, or of an mRNA thereof, in a biological sample from the patient.

Preferably, the at least one protein marker the level of expression of which is determined in step a) is selected from the group consisting of DAB2, FcγRIIa, FcγRIIIa, FTL, PECAM1, SLCO2B1, CD141, GATA3, RIPK4 and OX40L. Still preferably, the at least one protein marker the level of expression of which is determined in step a) is selected from the group consisting of DAB2, FcγRIIa, FcγRIIIa, FTL, PECAM1, SLCO2B1, CD141, GATA3 and RIPK4. Still preferably, the at least one protein marker the level of expression of which is determined in step a) is selected from the group consisting of FcγRIIIa, FTL, SLCO2B1, CD141 and GATA3. Still preferably, the at least one protein marker the level of expression of which is determined in step a) is selected from the group consisting of FcγRIIIa and FTL. Still preferably, the at least one protein marker the level of expression of which is determined in step a) is FcγRIIIa.

In the third aspect of the invention, the patient may be a patient suffering from an autoimmune disease or an allergy. Further, the patient may be treated against said disease.

In a preferred embodiment, the patient is undergoing immunotherapy and/or has been administered with a vaccine. Preferably, in this third aspect, the patient is undergoing an immunotherapy that aims at treating an allergy, preferably a desensitization therapy, the immunotherapy preferably aiming at reducing (i) the immune response against the allergen(s) which trigger(s) the allergy and/or (ii) manifestation of clinical symptoms of allergy.

Preferably, the method further comprises the steps of:
b) comparing the level of expression of the at least one marker protein, or of an mRNA thereof, measured in step a) with a control, and
c) based on the comparison of step b), determining if the patient is likely to be a responder to an immunotherapy and/or a vaccine aiming to treat an autoimmune disease or an allergy.

In the third aspect of the invention, the control may consist of immature and/or polarized dendritic cells, more preferably immature dendritic cells. Alternatively, the control may be a biological sample from a healthy donor, in particular of the same nature than that of the biological sample to be tested (e.g. peripheral blood when the biological sample to be tested is peripheral blood, etc). The control may alternatively consist of a biological sample from the patient obtained before the beginning of the treatment, in particular before said patient undergoes immunotherapy and/or is administered with a vaccine, said biological sample being in particular of the same nature than that of the biological sample to be tested.

Preferably when the above recited controls are used, the determination step c) of the method is as follows:

an increased level of expression of at least one marker protein selected from the group consisting of DAB2, FcγRIIa, FcγRIIIa, FTL, PECAM1, SLCO2B1, C3AR1, CD163, CD300LF, CFH, CSGALNACT1, P2RY14, ZBTB16, FcγRIIB, CYP1B1, DPYD, GCLC, IVNS1ABP, LRRC25, NUDT16, PDCD4, RNASE6, RNASET2, FcεRIG, MCTP1 and SIGLEC5, or of an mRNA thereof, and/or a decreased level of expression of at least one marker protein selected from the group consisting of CD141, GATA3, RIPK4, OX40L, CALCA, CREM, FMOD, HCRTR1, ILDR2, ITK, PADI2, PDE4D, PNOC, RGS9, ROR1, SIX2, SYT4, THBS1, TRIM9, ADAM8, CYTIP, NRP2, SEMA7A and TBC1 D13, or of an mRNA thereof, indicates that the patient is likely to be a responder to an immunotherapy and/or a vaccine aiming to treat an autoimmune disease or an allergy.

In a particular embodiment, the level of expression of at least three protein markers more preferably of at least five protein markers, is determined in step a).

Preferably, the level of expression of at least GATA3 is determined in step a). Still preferably, the level of expression of at least GATA3 and FcγRIIIa is determined in step a). Still preferably, the level of expression of at least GATA3, FcγRIIIa and FcγRIIa is determined in step a). Still preferably, the level of expression of at least GATA3, CD141, RIPK4, C1Q (C1QA, C1QB and/or C1QC) and FcγRIIIa is determined in step a).

In a particular embodiment, the level of expression of at least three protein markers more preferably of at least five protein markers, is determined in step a). Preferably, the level of expression of at least FcγRIIIa is determined in step a). Still preferably, the level of expression of at least FcγRIIIa and GATA3 is determined in step a). Still preferably, the level of expression of at least FcγRIIIa, GATA3 and FcγRIIa is determined in step a). Still preferably, the level of expression of at least FcγRIIIa, GATA3 and RIPK4 is determined in step a). Still preferably, the level of expression of at least FcγRIIIa, GATA3, CD141, RIPK4 and C1Q (C1QA, C1QB and/or C1QC) is determined in step a).

In another embodiment, the level of expression of at least one protein markers or mRNA thereof is combined with at least one marker protein or mRNA thereof of DCreg known in the prior art such as one described in International application WO 2013/034569.

In a fourth aspect, the present invention concerns a method, preferably an in vitro method, for determining if a patient is likely to be a responder to an immunotherapy and/or a vaccine aiming at inducing an immune response against an infectious pathogen or a tumor, which method comprises the step a) of determining the level of expression of at least one, preferably 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50, marker protein(s) selected from the group consisting of CD141, OX40L, DAB2, FcγRIIa, FcγRIIIa, FTL, PECAM1, SLCO2B1, GATA3, RIPK4, CALCA, CREM, FMOD, HCRTR1, ILDR2, ITK, PADI2, PDE4D, PNOC, RGS9, ROR1, SIX2, SYT4, THBS1, TRIM9, ADAM8, CYTIP, NRP2, SEMA7A, TBC1D13, FcεRIG, MCTP1, SIGLEC5, C3AR1, CD163, CD300LF, CFH, CSGALNACT1, P2RY14, ZBTB16, FcγRIIB, CYP1B1, DPYD, GCLC, IVNS1ABP, LRRC25, NUDT16, PDCD4, RNASE6 and RNASET2, or of an mRNA thereof, in a biological sample from the patient.

In the fourth aspect of the invention, the patient may be a patient suffering from an infectious disease or a tumor. Further, the patient may be treated against said disease.

In a preferred embodiment, the patient is undergoing immunotherapy and/or has been administered with a vaccine. Preferably, in this fourth aspect, the patient is undergoing an immunotherapy and/or has been administered with a vaccine that aims at inducing an immune response against the infectious pathogen responsible of the infectious disease or against the tumor.

Preferably, the method further comprises the steps of:
b) comparing the level of expression of the at least one marker protein, or of an mRNA thereof, measured in step a) with a control, and
c) based on the comparison of step b), determining if the patient is likely to be a responder to an immunotherapy and/or a vaccine aiming at inducing an immune response against an infections pathogen or a tumor.

In the fourth aspect of the invention, the control may consist of immature and/or polarized dendritic cells, more preferably immature dendritic cells. The control may alternatively consist of a biological sample from the patient obtained before the beginning of the treatment, in particular before said patient undergoes immunotherapy and/or is administered with a vaccine, said biological sample being in particular of the same nature than that of the biological sample to be tested.

Preferably when the above recited controls are used, the determination step c) of the method is as follows:
an increased level of expression of at least one marker protein selected from the group consisting of GATA3, RIPK4, CALCA, CREM, FMOD, HCRTR1, ILDR2, ITK, PADI2, PDE4D, PNOC, RGS9, ROR1, SIX2, SYT4, THBS1, TRIM9, ADAM8, CYTIP, NRP2, SEMA7A and TBC1 D13, or of an mRNA thereof, and/or a decreased level of expression of at least one marker protein selected from the group consisting of FcγRIIIa, FcεRIG, MCTP1, SIGLEC5, DAB2, FcγRIIa, FTL, PECAM1, SLCO2B1, C3AR1, CD163, CD300LF, CFH, CSGALNACT1, P2RY14, ZBTB16, FcγRIIB, CYP1B1, DPYD, GCLC, IVNS1ABP, LRRC25, NUDT16, PDCD4, RNASE6 and RNASET2, or of an mRNA thereof, indicates that the patient is likely to be a responder to an immunotherapy and/or a vaccine aiming inducing an immune response against an infectious pathogen or a tumor.

In a fifth aspect, the invention relates to a method, preferably an in vitro method, for determining if a dendritic cell is a type 2 dendritic cell, which method comprises the steps of:
a) determining the level of expression by the dendritic cell to be tested of at least one, 2, 3, 4, 5, 6, 7, 8, 9, 10, 11, 12, 13, 14, 15, 16, 17, 18, 19, 20, 21, 22, 23, 24, 25, 26, 27, 28 or 29, marker protein(s) selected from the group consisting of C1Q (C1QA, C1QB and/or C1QC), FcγRIIIa, GATA3, RIPK4, CALCA, CREM, FMOD, HCRTR1, ILDR2, ITK, PADI2, PDE4D, PNOC, RGS9, ROR1, SIX2, SYT4, THBS1, TRIM9, ADAM8, CYTIP, NRP2, SEMA7A, TBC1D13, C3AR1, CD163, FcγRIIa, FcεRIG, MCTP1, IVNS1ABP and SIGLECS, or of an mRNA thereof,
b) comparing said level of expression with that of a control, and
c) based on the comparison of step b), determining if the dendritic cell is a type 2 dendritic cell.

Preferably, the at least one marker protein the level of expression of which is determined in step a) is selected from the group consisting of CALCA, PNOC, ROR1 and SYT4. Still preferably, the at least one marker protein the level of expression of which is determined in step a) is selected from the group consisting of CREM, FMOD, GATA3, HCRTR1, ILDR2, ITK, PADI2, PDE4D, RGS9, RIPK4, SIX2, THBS1 and TRIM9. Still preferably, the at least one marker protein the level of expression of which is determined in step a) is selected from the group consisting of C1Q (C1QA, C1QB and/or C1QC), FcγRIIIa, C3AR1, CD163, FcγRIIa, FcεRIG, MCTP1, IVNS1ABP and SIGLEC5.

Preferably, the determination step c) of the method is as follows:
an increased level of expression of at least one marker protein selected from the group consisting of GATA3, RIPK4, CALCA, CREM, FMOD, HCRTR1, ILDR2, ITK, PADI2, PDE4D, PNOC, RGS9, ROR1, SIX2, SYT4, THBS1, TRIM9, ADAM8, CYTIP, NRP2, SEMA7A and TBC1 D13, or of an mRNA thereof, and/or
a decreased level of expression of at least one marker protein selected from the group consisting of C1Q (C1QA, C1QB and/or C1QC), FcγRIIIa, C3AR1, CD163, FcγRIIa, FcεRIG, MCTP1, IVNS1ABP and SIGLEC5, or of an mRNA thereof, indicates that the dendritic cell is a type 2 dendritic cell.

In a sixth aspect, the invention concerns a method, preferably an in vitro method, for determining if a dendritic cell is a tolerogenic dendritic cell, which method comprises the steps of:
a) determining the level of expression by the dendritic cell to be tested of at least one, preferably 2, 3, 4, 5, 6, 7, 8, 9, 10, 11, 12, 13, 14, 15, 16, 17, 18, 19, 20, 21, 22, 23, 24, 25 or 26, marker protein(s) selected from the group consisting of DAB2, FcγRIIa, FcγRIIIa, FTL, PECAM1, SLCO2B1, C3AR1, CD163, CD300LF, CFH, CSGALNACT1, P2RY14, ZBTB16, FcγRIIB, CYP1B1, DPYD, GCLC, IVNS1ABP, LRRC25, NUDT16, PDCD4, RNASE6, RNASET2, FcεRIG, MCTP1 and SIGLEC5, or of an mRNA thereof,
b) comparing said level of expression with that of a control, and
c) based on the comparison of step b), determining if the dendritic cell is a tolerogenic dendritic cell.

Preferably, the at least one marker protein the level of expression of which is determined in step a) is selected from the group consisting of C3AR1, CD163, CD300LF, CHF, CSGALNACT1, FcγRIIa, FcγRIIb, P2RY14 and ZBTB16. Still preferably, the at least one marker protein the level of expression of which is determined in step a) is selected from the group consisting of C3AR1, CD163, CD300LF, CHF, FcγRIIa, FcγRIIb and P2RY14. Still preferably, the at least one marker protein the level of expression of which is determined in step a) is selected from the group consisting of CYP1B1, DAB2, DPYD, FTL, GCLC, IVNS1ABP, LRRC25, NUDT16, PDCD4, PECAM1, RNASE6, RNASET2, and SLCO2B1. Still preferably, the at least one marker protein the level of expression of which is determined in step a) is selected from the group consisting of CD300LF, FcγRIIIa, FcγRIIa, PECAM1.

Preferably, the determination step c) of the method is as follows:
an increased level of expression of at least one marker protein selected from the group consisting of C3AR1, CD163, CD300LF, CFH, CSGALNACT1, P2RY14, ZBTB16, FcγRIIA, FcγRIIB, CYP1B1, DAB2, DPYD, FTL, GCLC, IVNS1ABP, LRRC25, NUDT16, PDCD4, RNASE6, RNASET2, SLCO2B1, FcεRIG, FcγRIIIA, MCTP1 and SIGLEC5, or of an mRNA thereof, indicates that the dendritic cell is a tolerogenic dendritic cell.

In the fifth or sixth aspect of the invention, the control may consist of polarized and/or immature dendritic cells, more preferably immature dendritic cells.

The application further discloses kits that are useful in the above methods.

Accordingly, in a seventh aspect, the invention concerns a kit for determining if a patient is developing an immune response oriented either towards a regulatory T cell response or towards a Th2 response, which kit comprises:
a) means for determining the level of expression of at least one, preferably 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47 or 48, marker protein(s) selected from the group consisting of DAB2, FcγRIIa, FcγRIIIa, FTL, PECAM1, SLCO2B1, GATA3, RIPK4, CALCA, CREM, FMOD, HCRTR1, ILDR2, ITK, PADI2, PDE4D, PNOC, RGS9, ROR1, SIX2, SYT4, THBS1, TRIM9, ADAM8, CYTIP, NRP2, SEMA7A, TBC1D13, FcεRIG, MCTP1, SIGLEC5, C3AR1, CD163, CD300LF, CFH, CSGALNACT1, P2RY14, ZBTB16, FcγRIIB, CYP1B1, DPYD, GCLC, IVNS1ABP, LRRC25, NUDT16, PDCD4, RNASE6 and RNASET2, or of an mRNA thereof,
b) a standard control curve showing a relationship between the level of expression of the marker proteins, or of an mRNA thereof, and the probable development of an immune response oriented towards a regulatory T cell response or towards a Th2 response, and
c) a control sample indicative of the level of expression of the marker proteins, or of an mRNA thereof, in a biological sample from an healthy patient.

The kit may further comprise instructions for the use of said kit in determining if the immune response is oriented either towards a regulatory T cell response or towards a Th2 response.

In an eighth aspect, the invention concerns a kit for determining if a patient is likely to be a responder to an immunotherapy and/or a vaccine aiming at treating an autoimmune disease or an allergy, which kit comprises:
a) means for determining the level of expression of at least one, preferably 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49 or 50, marker protein(s) selected from the group consisting of DAB2, FcγRIIa, FcγRIIIa, FTL, PECAM1, SLCO2B1, CD141, GATA3, RIPK4, OX40L, CALCA, CREM, FMOD, HCRTR1, ILDR2, ITK, PADI2, PDE4D, PNOC, RGS9, ROR1, SIX2, SYT4, THBS1, TRIM9, ADAM8, CYTIP, NRP2, SEMA7A, TBC1D13, FcεRIG, MCTP1, SIGLEC5, C3AR1, CD163, CD300LF, CFH, CSGALNACT1, P2RY14, ZBTB16, FcγRIIB, CYP1B1, DPYD, GCLC, IVNS1ABP, LRRC25, NUDT16, PDCD4, RNASE6 and RNASET2, or of an mRNA thereof,
b) a standard control curve showing a relationship between the level of expression of the marker proteins, or of an mRNA thereof, and the probable response to the immunotherapy and/or the vaccine, and
c) a control sample indicative of the level of expression of the marker proteins, or of an mRNA thereof, in a biological sample from a patient known to respond to the immunotherapy and/or the vaccine and/or from a patient known not to respond to the immunotherapy and/or the vaccine.

In a ninth aspect, the invention concerns a kit for determining if a patient is likely to be a responder to an immunotherapy and/or a vaccine aiming at inducing an immune response against an infectious pathogen or a tumor, which kit comprises:

a) means for determining the level of expression of at least one, preferably 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47 or 48, marker protein(s) selected from the group consisting of CD141, OX40L, DAB2, FcγRIIa, FcγRIIIa, FTL, PECAM1, SLCO2B1, GATA3, RIPK4, CALCA, CREM, FMOD, HCRTR1, ILDR2, ITK, PADI2, PDE4D, PNOC, RGS9, ROR1, SIX2, SYT4, THBS1, TRIM9, ADAM8, CYTIP, NRP2, SEMA7A, TBC1D13 FcεRIG, MCTP1, SIGLEC5, C3AR1, CD163, CD300LF, CFH, CSGALNACT1, P2RY14, ZBTB16, FcγRIIB, CYP1B1, DPYD, GCLC, IVNS1ABP, LRRC25, NUDT16, PDCD4, RNASE6 and RNASET2, or of an mRNA thereof, b) a standard control curve showing a relationship between the level of expression of the marker proteins, or of an mRNA thereof, and the probable response to the immunotherapy and/or the vaccine, and c) a control sample indicative of the level of expression of the marker proteins, or of an mRNA thereof, in a biological sample from a patient known to respond to the immunotherapy and/or the vaccine and/or from a patient known not to respond to the immunotherapy and/or the vaccine.

In the eighth and ninth aspect of the invention, the kit may further comprise instructions for the use of said kit in determining if the patient is responding to the immunotherapy.

In a tenth aspect, the invention concerns a kit for determining if a dendritic cell is a type 2 dendritic cell, which kit comprises:

a) means for determining the level of expression of at least one, preferably 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32 or 33, marker protein(s) selected from the group consisting of C1Q (C1QA, C1QB and/or C1QC), FcγRIIIa, GATA3, RIPK4, CALCA, CREM, FMOD, HCRTR1, ILDR2, ITK, PADI2, PDE4D, PNOC, RGS9, ROR1, SIX2, SYT4, THBS1, TRIM9, ADAM8, CYTIP, NRP2, SEMA7A, TBC1D13, C3AR1, CD163, FcγRIIa, FcεRIG, MCTP1, IVNS1ABP and SIGLEC5, or of an mRNA thereof, b) a standard control curve showing a relationship between the level of expression of the marker proteins, or of an mRNA thereof, and the probable subset to which the dendritic cell belongs, and c) a control sample indicative of the level of expression of the marker proteins, or of an mRNA thereof, in an immature dendritic cell.

The kit may further comprise instructions for the use of said kit in determining if the dendritic cell is a type 2 dendritic cell.

In an eleventh aspect, the present invention concerns a kit for determining if a dendritic cell is a tolerogenic dendritic cell, which kit comprises:

a) means for determining the level of expression of at least one, preferably 2, 3, 4, 5, 6, 7, 8, 9, 10, 11, 12, 13, 14, 15, 16, 17, 18, 19, 20, 21, 22, 23, 24, 25 or 26, marker protein(s) selected from the group consisting of DAB2, FcγRIIa, FcγRIIIa, FTL, PECAM1, SLCO2B1, C3AR1, CD163, CD300LF, CFH, CSGALNACT1, P2RY14, ZBTB16, FcγRIIB, CYP1B1, DPYD, GCLC, IVNS1ABP, LRRC25, NUDT16, PDCD4, RNASE6, RNASET2, FcεRIG, MCTP1 and SIGLEC5, or of an mRNA thereof, b) a standard control curve showing a relationship between the level of expression of the marker proteins, or of an mRNA thereof, and the probable subset to which the dendritic cell belongs, and c) a control sample indicative of the level of expression of the marker proteins, or of an mRNA thereof, in an immature dendritic cell.

The kit may further comprise instructions for the use of said kit in determining if the dendritic cell is a tolerogenic dendritic cell.

Optionally, the kits of the invention may further comprise means for measuring the expression level of some housekeeping genes.

In a preferred embodiment, the kits according to the invention comprise, in addition to the means for determining the level of expression of at least the recited marker protein(s), or for determining the expression of an mRNA thereof, a control sample comprising a known amount of the marker protein(s) to be measured.

The kits of the invention may further comprise a packaging.

Means for determining the level of expression of the marker proteins, or of the mRNA thereof, which are recited herein, in particular in Tables 1, 2 and 3, are well-known in the art. They include, e.g. reagents allowing the detection of mRNA by real-time quantitative-PCR, such as primers specific for the marker proteins to be measured. When the kit comprises means for real-time quantitative-PCR mRNA detection, the kit may further comprise a second reagent, labeled with a detectable compound, which binds to mRNA synthesized during the PCR, such as e.g. SYBER GREEN reagents or TaqMan reagents.

Means for determining the level of expression of the marker proteins may also include antibodies or aptamers specifically binding to the marker proteins to be measured. Such means can be labeled with detectable compound such as fluorophores or radioactive compounds. For example, the probe or the antibody specifically binding to the marker proteins may be labeled with a detectable compound. Alternatively, when the kit comprises an antibody, the kit may further comprise a secondary antibody, labeled with a detectable compound, which binds to an unlabelled antibody specifically binding to the marker protein(s) to be measured. Means for determining the level of expression of the marker proteins may also include calibration standard peptide or protein, with or without mass modifying label.

The means for measuring the level of expression of the marker proteins may also include reagents such as e.g. reaction, hybridization and/or washing buffers. The means may be present, e.g., in vials or microtiter plates, or be attached to a solid support such as a microarray as can be the case for primers and probes.

In a twelfth aspect, the present invention concerns an in vitro method for screening for compounds which are suitable for polarizing a dendritic cell towards the type 2 dendritic cell subset, which method comprises the steps of:
a) providing a test compound,
b) contacting immature dendritic cells with the test compound,
c) determining the level of expression by the dendritic cell of at least one protein marker selected from the group consisting of C1Q (C1QA, C1QB and/or C1QC), FcγRIIIa, GATA3, RIPK4, CALCA, CREM, FMOD, HCRTR1, ILDR2, ITK, PADI2, PDE4D, PNOC, RGS9, ROR1, SIX2, SYT4, THBS1, TRIM9, ADAM8, CYTIP, NRP2, SEMA7A, TBC1D13, C3AR1, CD163, FcγRIIa, FcεRIG, MCTP1, IVNS1ABP and SIGLEC5, or of an mRNA thereof, wherein
the determination that the level of expression of at least one protein marker, selected from the group consisting of GATA3, RIPK4, CALCA, CREM, FMOD, HCRTR1, ILDR2, ITK, PADI2, PDE4D, PNOC, RGS9, ROR1, SIX2, SYT4, THBS1, TRIM9, ADAM8, CYTIP, NRP2, SEMA7A and TBC1D13, or of an mRNA thereof, by the dendritic cells contacted with the test compound is higher than the level of expression of said protein marker, or an mRNA thereof, by a control sample consisting of immature dendritic cells which has not been contacted with the test compound, and/or the determination that the level of expression of at least one protein marker, selected from the group consisting of C1Q (C1QA, C1QB and/or C1QC), FcγRIIIa, C3AR1, CD163, FcγRIIa, FcεRIG, MCTP1, IVNS1ABP and SIGLEC5, or of an mRNA thereof, by the dendritic cells contacted with the test compound is lower than the level of expression of said protein marker, or an mRNA thereof, by a control sample consisting of immature dendritic cells which has not been contacted with the test compound, indicates that said test compound is suitable for polarizing a dendritic cell towards the type 2 dendritic cell subset.

In a thirteenth aspect, the present invention also concerns an in vitro method for screening for compounds which are suitable for polarizing a dendritic cell towards the tolerogenic dendritic cell subsets, which method comprises the steps of:

a) providing a test compound,
b) contacting immature dendritic cells with the test compound,
c) determining the level of expression by the dendritic cell of at least one protein marker selected from the group consisting of DAB2, FcγRIIa, FcγRIIIa, FTL, PECAM1, SLCO2B1, C3AR1, CD163, CD300LF, CFH, CSGAL-NACT1, P2RY14, ZBTB16, FcγRIIB, CYP1B1, DPYD, GCLC, IVNS1ABP, LRRC25, NUDT16, PDCD4, RNASE6, RNASET2, FcεRIG, MCTP1 and SIGLEC5, or of an mRNA thereof, wherein the determination that the level of expression of at least one protein marker, selected from the group consisting of DAB2, FcγRIIa, FcγRIIIa, FTL, PECAM1, SLCO2B1, C3AR1, CD163, CD300LF, CFH, CSGALNACT1, P2RY14, ZBTB16, FcγRIIB, CYP1B1, DPYD, GCLC, IVNS1ABP, LRRC25, NUDT16, PDCD4, RNASE6, RNASET2, FcεRIG, MCTP1 and SIGLEC5, or of an mRNA thereof, by the dendritic cells contacted with the test compound is higher than the level of expression of said protein marker, or an mRNA thereof, by a control sample consisting of immature dendritic cells which has not been contacted with the test compound, indicates that said test compound is suitable for polarizing a dendritic cell towards the tolerogenic dendritic cell subsets.

In a fourteenth aspect, the present invention also concerns an in vitro method for screening for compounds which are suitable in a patient for shifting from a Th2 response towards a tolerogenic T cell response, which method comprises the steps of:

a) providing a test compound,
b) contacting immature and/or type 2 dendritic cells with the test compound,
c) determining the level of expression by the dendritic cell of at least one protein marker selected from the group consisting of DAB2, FcγRIIa, FcγRIIIa, FTL, PECAM1, SLCO2B1, CD141, GATA3, RIPK4, OX40L, CALCA, CREM, FMOD, HCRTR1, ILDR2, ITK, PADI2, PDE4D, PNOC, RGS9, ROR1, SIX2, SYT4, THBS1, TRIM9, ADAM8, CYTIP, NRP2, SEMA7A, TBC1D13, FcεRIG, MCTP1, SIGLEC5, C3AR1, CD163, CD300LF, CFH, CSGALNACT1, P2RY14, ZBTB16, FcγRIIB, CYP1B1, DPYD, GCLC, IVNS1ABP, LRRC25, NUDT16, PDCD4, RNASE6 and RNASET2, or of an mRNA thereof, wherein the determination that the level of expression of at least one protein marker, selected from the group consisting of DAB2, FcγRIIa, FcγRIIIa, FTL, PECAM1, SLCO2B1, C3AR1, CD163, CD300LF, CFH, CSGALNACT1, P2RY14, ZBTB16, FcγRIIB, CYP1B1, DPYD, GCLC, IVNS1ABP, LRRC25, NUDT16, PDCD4, RNASE6, RNASET2, FcεRIG, MCTP1 and SIGLEC5, or of an mRNA thereof, by the dendritic cells contacted with the test compound is higher than the level of expression of said protein marker, or an mRNA thereof, by a control sample consisting of immature dendritic cells which has not been contacted with the test compound, and/or wherein the determination that the level of expression of at least one protein marker, selected from the group consisting of GATA3, RIPK4, CALCA, CREM, FMOD, HCRTR1, ILDR2, ITK, PADI2, PDE4D, PNOC, RGS9, ROR1, SIX2, SYT4, THBS1, TRIM9, ADAM8, CYTIP, NRP2, SEMA7A and TBC1D13, or of an mRNA thereof, by the dendritic cells contacted with the test compound is lower than the level of expression of said protein marker, or an mRNA thereof, by a control sample consisting of immature dendritic cells which has not been contacted with the test compound indicates that said test compound is suitable for shifting from a Th2 response towards a tolerogenic T cell response.

The method may further allow identifying compounds suitable for use in the treatment of allergy.

Marker Proteins

The term "marker protein" includes all isoforms of said proteins. Thus, for the marker proteins described above, the term "marker protein" includes the polypeptide having the amino acid sequences disclosed herein and all isoforms thereof. "Isoform" refers to all alternative forms of a protein, for example amino-acid substituted forms, alternatively spliced versions and post-translationally modified forms such as glycoforms. Post-translationally modified isoforms may include acetylated, formylated, lipoylated, myristoylated, palmitoylated, alkylated, methylated, amidated, glycosylated, hyrdroxylated, nitrosylated, phosphorylated, sulphated, polysialylated and sialylated forms. Isoforms include naturally occurring variants, allelic variants, SNPs (single nucleotide polymorphisms), alternative splice variants and truncated or secreted forms of the protein. Alternatively spliced and truncated mRNAs encoding the marker proteins may also be detected.

Detection of the "level of expression" of a marker protein may refer to the level of expression of any individual isoform of said protein, the collective level of expression of selected isoforms of said protein, or the total level of expression of said protein including the reference sequence and all isoforms.

The marker proteins described herein are defined in Tables 1, 2 and 3 below.

In one embodiment, the marker proteins have the sequence corresponding to the Uni-Prot/Swiss-Prot accession number recited in Tables 1, 2 and 3 below. In another embodiment, the marker proteins comprise or consist of one of the sequences set forth under the corresponding SEQ ID recited in Tables 1, 2 and 3 below.

TABLE 1

| Marker | Protein name | Synonyms | UniProt/SwissProt Accession No. | SEQ ID NO: |
|---|---|---|---|---|
| DAB2 | Disabled homolog 2 | DOC-2; differentially-expressed protein 2 | P98082 | 1-3 |
| FTL | Ferritin light chain | Ferritin L subunit | P02792 | 6 |
| PECAM1 | Platelet endothelial cell adhesion molecule | EndoCAM; GPIIA'; PECA1; CD31 | P16284 | 7-12 |
| SLCO2B1 | Solute carrier organic anion transporter family member 2B1 | Organic anion transporter B; OATP-B; Organic anion transporter polypeptide-related protein 2; OATP-RP2; OATPRP2: Solute carrier family 21 member 9 | O94956 | 13-16 |
| CD300LF | CMRF35-like molecule 1 | CLM-1; CD300 antigen-like family member F; Immune receptor expressed on myeloid cells 1; IREM-1; immunoglobulin superfamily member 13; IgSF13; NK inhibitory receptor; CD300f | Q8TDQ1 | 22-27 |
| CFH | Complement factor H | H factor 1; HF; HF1; HF2 | P08603 | 28-29 |
| CSGALNACT1 | Chondroitin sulfate N-acetylgalactosaminyl-transferase 1 | CsGalNAcT-1; Chondroitin beta-1,4-N-acetylgalactosaminyltransfe 1; Beta4GalNAct-1; CHGN; GALNACT1 | Q8TDX6 | 30-32 |
| P2RY14 | P2Y purinoceptor 14 | P2Y14; G-protein coupled receptor 105; UDP-glucose receptor; GPR105 | Q15391 | 33 |
| ZBTB16 | Zinc finger and BTB domain-containing protein 16 | Promyelocytic leukemia zinc finger protein; Zinc finger protein 145; Zinc finger protein PLZF; PLZF; ZNF145 | Q05516 | 34-35 |
| FcγRIIB | Low affinity immunoglobulin gamma Fc region receptor II-b | IgG Fc receptor II-b; CDw32; FCGR2B; CD32; FcRII-b | P31994 | 36-38 |
| CYP1B1 | Cytochrome P450 1B1 | CYPIB1 | Q16678 | 39 |
| DPYD | Dihydropyrimidine dehydrogenase [NADP(+)] | DHPDHase; DPD; Dihydrothymine dehydrogenase; Dihydrouracil dehydrogenase | Q12882 | 40-41 |
| GCLC | Glutamate-cysteine ligase catalytic subunit | GCS heavy chain; Gamma-ECS; Gamma-glutamylcysteine synthetase | P48506 | 42 |
| LRRC25 | Leucine-rich repeat-containing protein 25 | Monocyte and plasmacytoid-activated protein | Q8N386 | 44 |
| NUDT16 | U8 snoRNA-decapping enzyme | IDP phosphatase; IDPase; Inosine diphosphate phosphatase; Nucleoside diphosphate-linked moiety X motif 16; Nudix motif 16; U8 snoRNA-binding protein H29K; m7GpppN-mRNA hydrolase | Q96DE0 | 45-48 |
| PDCD4 | Programmed cell death protein 4 | Neoplastic transformation inhibitor protein; Nuclear antigen H731-like; Protein 197/15a | Q53EL6 | 49-50 |
| RNASE6 | Ribonuclease K6 | RNase K6 | Q93091 | 51 |
| RNASET2 | Ribonuclease T | Ribonuclease 6; RNASE6PL | O00584 | 52-53 |

TABLE 2

Marker proteins used to identify DCreg and DC2

| Marker | Protein name | Synonyms | UniProt/SwissProt Accession No. | SEQ ID NO: |
|---|---|---|---|---|
| FcγRIIIa | Low affinity immunoglobulin gamma Fc region receptor III-A | CD16a antigen; Fc-gamma RIII-alpha; Fc-gamma RIII; Fc-gamma RIIIa; FcRIII; FcRIIIa; FcR-10; IgG Fc receptor III-2; CD16a; FCGR3A | P08637 | 54 |
| FcγRIIIa | Low affinity immunoglobulin gamma Fc region receptor II-a | IgG Fc receptor II-a; CDw32; Fc-gamma RIII-a; Fc-gamma-RIIIa; FcRII-a; CD32 | P12318 | 4-5 |
| C3AR1 | C3a anaphylatoxin chemotactic receptor | C3AR; AZ3B, C3R1, HNFAG09 | Q16581 | 17 |
| CD163 | Scavenger receptor cysteine-rich type 1 protein M130 | Hemoglobin scavenger receptor; M130 | Q86VB7 | 18-21 |
| IVNS1ABP | Influenza virus NS1A-binding protein | NS1-BP; NS1-binding protein; Aryl hydrocarbon receptor-associated protein 3 | Q9Y6Y0 | 43 |
| FcεRIG | High affinity immunoglobulin epsilon receptor subunit gamma | Fc receptor gamma-chain; FcRgamma; Fc-epsilon RI-gamma; IgE Fc receptor subunit gamma; FceRI gamma; FCER1G | P30273 | 56 |
| MCTP1 | Multiple C2 and transmembrane domain-containing protein 1 | — | Q6DN14 | 57-61 |
| SIGLEC5 | Sialic acid-binding Ig-like lectin 5 | Siglec-5; CD33 antigen-like 2; Obsesity-binding protein 2; OB-BP2; OB-binding protein 2; CD170; CD33L2; OBBP2 | O15389 | 62 |

TABLE 3

Marker proteins used to identify DC2

| Marker | Protein name | Synonyms | UniProt/SwissProt Accession No. | SEQ ID NO: |
|---|---|---|---|---|
| C1QA | Complement C1q subcomponent subunit A | — | P02745 | 55 |
| C1QB | Complement C1q subcomponent subunit B | — | P02746 | 152 |
| C1QC | Complement C1q subcomponent subunit C | — | P02747 | 153 |
| GATA3 | Trans-acting T cell-specific transcription factor GATA-3 | GATA-binding factor 3 | P23771 | 63-64 |
| RIPK4 | Receptor-interacting serine/threonine-protein kinase 4 | Ankyrin repeat domain-containing protein 3; PKC-delta-interacting protein kinase | P57078 | 65-66 |
| CALCA | Calcitonin gene-related peptide 1 | Alpha-type CGRP; Calcitonin gene-related peptide I; CGRP-I | P06881 | 67 |
| CREM | cAMP-responsive element modulator | Inducible cAMP early repressor; ICER | Q03060 | 68-96 |
| FMOD | Fibromodulin | FM; Collagen-binding 59 kDa protein; Keratan sulfate proteoglycan fibromodulin; KSPG fibromodulin | Q06828 | 97 |
| HCRTR1 | Orexin receptor type 1 | Ox-1-R; Ox1-R; Ox1R; Hypocretin receptor type 1 | O43613 | 98 |
| ILDR2 | Immunoglobulin-like domain-containing receptor 2 | — | Q71H61 | 99 |
| ITK | Tyrosine-protein kinase ITK/TSK | Interleukin-2-inducible T-cell kinase; IL-2-inducible T-cell kinase; Kinase EMT; T-cell-specific kinase; Tyrosine-protein kinase Lyk; EMT; LYK | Q08881 | 100 |
| PADI2 | Protein-arginine deiminase type-2 | PAD-H19; Peptidylarginine deiminase II; Protein-arginine deiminase type II | Q9Y2J8 | 101-102 |
| PDE4D | cAMP-specific 3',5'-cyclic phosphodiesterase 4D | DPDE3; PDE43 | Q08499 | 103-114 |
| PNOC | Prepronociceptin | — | Q13519 | 115-116 |

TABLE 3-continued

Marker proteins used to identify DC2

| Marker | Protein name | Synonyms | UniProt/ SwissProt Accession No. | SEQ ID NO: |
|---|---|---|---|---|
| RGS9 | Regulator of G-protein signaling 9 | — | O75916 | 117-121 |
| ROR1 | Tyrosine-protein kinase transmembrane receptor ROR1 | Neurotrophic tyrosine kinase, receptor-related 1; NTRKR1 | Q01973 | 122-124 |
| SIX2 | Homeobox protein SIX2 | Sine oculis homeobox homolog 2 | Q9NPC8 | 125 |
| SYT4 | Synaptotagmin-4 | Synaptotagmin IV; SytIV | Q9H2B2 | 126 or 127 |
| THBS1 | Thrombospondin-1 | — | P07996 | 128-129 |
| TRIM9 | E3 ubiquitin-protein ligase TRIM9 | RING finger protein 91; Tripartite motif-containing protein 9 | Q9C026 | 130-132 |
| ADAM8 | Disintegrin and metalloproteinase domain-containing protein 8 | Cell surface antigen MS2; CD156a | P78325 | 133-135 |
| CYTIP | Cytohesin-interacting protein | Cytohesin binder and regulator; CYBR; Cytohesin-associated scaffolding protein; CASP; Cytohesin-binding protein HE; Cbp HE; Pleckstrin homology Sec7 and coiled-coil domains-binding protein | O60759 | 136-137 |
| NRP2 | Neuropilin-2 | Vascular endothelial cell growth factor 165 receptor 2 | O60462 | 138-143 |
| SEMA7A | Semaphorin-7A | CDw108; JMH blood group antigen; John-Milton-Hargen human blood group Ag; Semaphorin-K1; Sema K1; Semaphorin-L; Sema L; CD108 | O75326 | 144-145 |
| TBC1D13 | TBC1 domain family member 13 | — | Q9NVG8 | 146-148 |
| OX4OL | Tumor necrosis factor ligand superfamily member 4 | Glycoprotein Gp34; OX40 ligand; TAX transcriptionally-activated glycoprotein 1; CD252; TNFSF4; TNFL4 | P23510 | 149-150 |
| CD141 | Thrombomodulin | TM; Fetomodulin; TRBM THBD | P07204 | 151 |

In the context of the invention, the above cited Swiss Prot references are those that were available on Oct. 28, 2014.

In some embodiments, the methods of the invention involve detection of a single marker protein or protein isoform of the proteins listed in Tables 1, 2 and 3, or an mRNA thereof. In other embodiments, more than one protein or protein isoform listed in Tables 1, 2 and 3, or an mRNA thereof, is detected, for example at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52 or at least 53 proteins or protein isoforms, or the mRNAs thereof.

An increase or decrease in the level of expression of a protein isoform, or an mRNA thereof, may be detected in a biological sample compared to a control, as detailed below. The fold change in the patient sample compared to the control may be at least 2, at least 2,3, at least 3, at least 4, at least 5, at least 10, at least 15, at least 17, at least 20, at least 30, at least 40, at least 50, at least 60, at least 70, at least 80, at least 90, at least 100, at least 200, at least 300, at least 400 or at least 500-fold.

As used throughout the present specification, any reference to the "marker proteins" recited in Tables 1, 2 and 3 is meant to encompass any naturally occurring isoform of the marker proteins naturally encoded by human, but also their homologous and orthologous counterpart of other animals.

The patient is preferably a mammal, such as a rodent, a feline, an equine, a bovine, an ovine, a canine or a primate, and is preferably a human, in particular a child, a woman, a man.

Depending on the origin of sample to be tested (e.g. a rodent, a feline, an equine, a bovine, an ovine, a canine or a primate . . . ), the person skilled in the art will easily determine which are the sequences of the markers to be detected by consulting the commonly known sequence databases and will therefore choose the means suitable for detecting these markers.

For instance, when the patient is a human, the term "marker proteins" is intended to mean any naturally occurring isoform of the marker proteins naturally encoded by human genome, including the protein having an amino acid sequence corresponding to the sequences of accession number and of SEQ ID listed in Tables 1, 2 and 3, human equivalents of the non-human sequences listed, allelic variants thereof and splice variants thereof.

Biological Sample

The biological sample may be, without limitation, blood (e.g. peripheral blood, PBMCs), plasma, serum, mucosal (e.g. nasal secretion, saliva), bronchoalveolar cerebrospinal fluid or urine. In a particularly preferred embodiment, the biological sample is a blood sample, more preferably a blood serum sample. Still preferably, the biological sample comprises PBMCs.

The biological sample may as well be tissues, epithelial brushings, most particularly from mucosal surfaces. In some embodiments, said biological sample contains antigen-presenting cells (i.e. monocytes, macrophages and/or dendritic cells), more preferably dendritic cells. However, it is not necessary for the sample to contain antigen-presenting cells, as the marker protein may be secreted and may be detected in body fluids or tissues which do not contain the antigen-presenting cells themselves.

In some embodiments, the biological sample is preferably taken before the commencement of therapy or before the planned commencement of therapy. In other embodiment, the biological sample may also be taken after the commencement of therapy, for example after one round of therapy is completed in order to decide whether to proceed to further rounds. In particular, where the method comprises determining if a patient undergoing immunotherapy is likely to respond to said immunotherapy, samples taken before the commencement of therapy, during therapy and/or at the end of therapy may be required.

In all aspect of the invention relating to allergy, the biological sample is preferably peripheral blood, blood serum or PBMCs sample, nasal secretion, saliva or bronchoalveolar fluid, mucosal tissues or epithelial brushing.

Control

The expression of the marker proteins by dendritic cells to be tested, or where appropriate in a patient biological sample, may be compared with a control standard value and/or or with the expression of said marker protein in a control sample as explained above, for instance a control sample of the same nature.

A standard value may be obtained by, for example, detecting the level of expression in a given subset of dendritic cells (e.g. immature dendritic cells, type 1, type 2 or tolerogenic dendritic cells) or in a given group of subjects (for instance healthy donors, patients developing an immune response oriented towards a regulatory T cell response or towards a Th2 response, patients previously identified as a responder to a treatment, or patients previously identified as a non-responder to a treatment) and obtaining an average or median figure.

The control sample may consist of immature dendritic cells.

In the context of the invention, the term "immature dendritic cells" is intended to mean that the dendritic cells are not activated and have not been polarized towards tolerogenic or effector subsets. Immature dendritic cells may be obtained from monocytes sorted out from peripheral blood (e.g. from PBMCs) by method well known from the one skilled in the art. Such methods are for instance disclosed in Sallusto and Lanzavecchia, J Exp Med, 179:1109-1118, 1994, and in Example 1 of the present application. Other sources of DCs include plasmacytoid DCs (from blood, PBMCs, tissues), dermal DCs and Langerhans cells (from skin or mucosal tissues).

The term "polarized dendritic cells" is intended to mean that the dendritic cells are activated and have been polarized towards tolerogenic or effector subsets. Polarized dendritic cells of specific subtypes may be obtained from immature dendritic cells by method well known from the one skilled in the art As will be clear to the skilled person, the nature of the comparison of the dendritic cell to be tested, or where appropriate of the patient biological sample to be tested, with the control and the conclusions drawn will depend on the nature of the control.

For instance, where the marker protein is disclosed herein as a protein displaying an increased level of expression in tolerogenic dendritic cells and the control is based on immature dendritic cells, a value the same as or similar to, or lower than, the control may be indicative that the dendritic cell to be tested is not a tolerogenic dendritic cell, whereas a value higher than the control may be indicative that the dendritic cell to be tested is a tolerogenic dendritic cell. Conversely, where the control is based on tolerogenic dendritic cells, a value the same as or similar to the control may be indicative that the dendritic cell to be tested is a tolerogenic dendritic cell.

Similarly, where the marker protein is disclosed herein as a protein displaying an increased level of expression in type 2 dendritic cells and the control is based on immature dendritic cells, a value the same as or similar to, or lower than, the control may be indicative that the dendritic cell to be tested is not a type 2 dendritic cell, whereas a value higher than the control may be indicative that the dendritic cell to be tested is a type 2 dendritic cell. Conversely, where the control is based on type 2 dendritic cells, a value the same as or similar to the control may be indicative that the dendritic cell to be tested is a type 2 dendritic cell.

Similarly, where the marker protein is disclosed herein as a protein displaying a decreased level of expression in type 2 dendritic cells and the control is based on immature dendritic cells, a value the same as or similar to, or higher than, the control may be indicative that the dendritic cell to be tested is not a type 2 dendritic cell, whereas a value lower than the control may be indicative that the dendritic cell to be tested is a type 2 dendritic cell. Conversely, where the control is based on type 2 dendritic cells, a value the same as or similar to the control may be indicative that the dendritic cell to be tested is a type 2 dendritic cell.

The same type of reasoning applies to determine if a patient is developing an immune response oriented either towards a regulatory T cell response or towards a Th2 response.

For instance, concerning the embodiments wherein the patient has not been treated, as exemplified above, the control may be immature dendritic cells, in particular which have not been polarized towards tolerogenic or effector subsets, or a biological sample from a healthy donor of the same nature than that of the biological sample to be tested. The control may also be type 2 dendritic cells, tolerogenic dendritic cells, biological sample of a patient who is developing a regulatory T cell response, biological sample of a patient who is developing a Th2 response. On the basis of a reasoning similar to that above in relation to the determination of to which dendritic cell subset belongs the DCs to be tested, depending on the type of control, the person skilled in the art will be able to determine if a patient is developing an immune response oriented either towards a regulatory T cell response or towards a type 2 response.

Regarding the embodiments wherein the patient has been treated, as exemplified above, the control may be a biological sample from a patient or group of patients of the same nature as that of the biological sample to be tested, which sample has been obtained before the treatment begins. Preferably, the control is a pre-treatment sample taken from the patient undergoing treatment. The control may also be type 2 dendritic cells, tolerogenic dendritic cells, a biological sample from a patient who is developing a regulatory T cell response, a biological sample from a patient who is developing a Th2 response. Further, when one wishes to determine if the patient will likely be a responder or a non-responder to a treatment, the control may be a biological sample from a healthy donor, a biological sample from a patient previously identified as a responder to the treatment, a biological sample from a patient previously identified as a non-responder to the treatment (biological samples of the same nature than that of the biological sample to be tested) and, where the sample is a patient sample, the sample is obtained before the beginning of treatment.

The methods according to the first, second, third and fourth aspects of the invention may in particular be used to monitor patients during therapy to establish whether they are responding to therapy, an increase or decrease in marker protein expression during therapy being indicative of responsiveness to treatment.

Where the marker protein is disclosed herein as a protein displaying an increased level of expression in responder subjects and the control is based on a non-responder subject or group of such subjects, a value the same as or similar to, or lower than, the control may be indicative of non-responsiveness to therapy, whereas a value higher than the control may be indicative of responsiveness to therapy. Conversely, where the control is based on a responder subject or group of such subjects, a value the same as or similar to, or higher than, the control may be indicative of responsiveness to therapy, whereas a value lower than the control may be indicative of non-responsiveness to therapy. Where the control is based on an average or median value obtained from a random group of subjects, a value higher than the control may be indicative of responsiveness to therapy.

Similarly, where the marker protein is disclosed herein as a protein displaying a decreased level of expression in responder subjects and the control is based on a non-responder subject or group of such subjects, a value the same as or similar to, or higher than, the control may be indicative of non-responsiveness to therapy, whereas a value lower than the control may be indicative of responsiveness to therapy. Where the control is based on a responder subject or group of such subjects, a value the same as or similar to, or lower than, the control may be indicative of responsiveness to therapy, whereas a value higher than the control may be indicative of non-responsiveness to therapy. Where the control is based on an average or median value obtained from a random group of subjects, a value lower than the control may be indicative of responsiveness to therapy.

Detection of Marker Proteins/Determination of the Level of Expression of Markers Proteins The level of expression of the marker protein may be determined by gel electrophoresis (SDS-PAGE), in particular one and two-dimensional gel electrophoresis (1D-, 2D-PAGE), carried out on the sample or a protein-containing extract thereof. 2D-PAGE is a well-established technique in which proteins are first separated in one dimension by isoelectric focusing and further separated by SDS-PAGE along a second dimension. Protein expression may be analyzed by visualization of labeled proteins, or by western blotting (i.e. using a monoclonal or polyclonal antibody). Protein quantitation by 2D-PAGE is usually carried out by 2D-DiGE, in which proteins from a control sample and the test sample are labeled with different dyes. The dyes are of similar mass and identical charge so the labeled proteins migrate to the same position on the gel, allowing quantitation to be carried out within a single gel.

The level of expression of the marker protein may also be determined by mass spectrometry assays (LC-MS or LC-MS/MS). Qualitative and quantitative mass spectrometric techniques are known and used in the art. To this aim, target peptides specific for marker proteins are selected and quantified based on calibration curves established with synthetic peptides labeled with stable isotopes. Enzymatic digests, spiked with a defined amount of isotope labeled target peptides, are analyzed by liquid chromatography coupled with mass spectrometry. The ratio between labeled and non-labeled target peptides is measured to assess target peptide concentrations and therefore protein marker concentration.

The level of expression of the marker protein may also be determined using an antibody which binds to the protein, for example a monoclonal or polyclonal antibody, an antibody variant or fragments such as a single chain antibody, a diabody, a minibody, a single chain Fv fragment (sc(Fv)), a $Sc(Fv)_2$ antibody, a Fab fragment or a $F(ab')_2$ fragment, a $V_HH$ antibody or a single domain antibody. The antibody may be mono-, bi-, tri- or multivalent. The antibody may be immobilized on a solid support. Antibodies may be used to determine protein expression in a range of immunological assays including competitive and non-competitive assay systems using techniques such as western blotting, immunohistochemistry/immunofluorescence (i.e protein detection on fixed cells or tissues), radioimmunoassay such as RIA (radio-linked immunoassay), ELISA (enzyme linked immunosorbent assay), "sandwich" immunoassays, immunoprecipitation assays, immunodiffusion assays, agglutination assays, complement-fixation assays, immunoradiometric assays, fluorescent immunoassays, e.g. FIA (fluorescence-linked immunoassay), chemiluminescence immunoassays, ECLIA (electrochemiluminescence immunoassay) and protein A immunoassays. Such assays are routine and well known to the person skilled in the art.

The level of expression of the marker protein may alternatively be determined using a protein-specific aptamer. An aptamer is a short peptide capable of specifically binding to a specific protein sequence, consisting of a variable peptide loop attached at both ends to a protein scaffold. Methods for making protein aptamers are well known in the art, the most commonly used method being the yeast two-hybrid system. Such aptamers may preferably be labeled in order to allow the detection of a protein-ligand interaction. A nanotechnology-based assay could also be used.

Accordingly, in particular embodiments, the level of expression of the at least one marker protein as defined above is determined by immunological assay, mass spectrometry assays or gel electrophoresis.

Detection of mRNA of the Marker Proteins/Determination of the Level of Expression of mRNA of the Markers Proteins The level of expression of mRNAs of the marker proteins may be determined by real-time quantitative RT-PCR, using primers specific for the marker proteins to be measured. This method allows the detection of mRNA in a biological sample by generating cDNA by reverse transcription using at least one primer; amplifying the cDNA so produced using gene specific polynucleotides as sense and antisense primers and detecting the presence of the amplified cDNA by methods well known to the person skilled in the art. This includes cDNA amplification with specific predesigned

Therapeutic Applications

"Therapy", "therapeutic", "treatment" or "treating" include reducing, alleviating or inhibiting or eliminating the symptoms of diseases (e.g. infectious diseases, tumors, autoimmune diseases) or of pathological conditions (e.g. allergy), as well as treatment intended to reduce, alleviate, inhibit or eliminate said symptoms. These terms may include preventive treatment which is intended to, or has the effect of, reducing, alleviating, inhibiting or eliminate future symptoms. They may also include treatment of ongoing symptoms.

By "a tumor" is meant any type of cancerous (malignant) tumor. The malignant tumor may be for instance carcinomas, adenocarcinomas, sarcomas, malignant melanomas, mesotheliomas, blastomas. The carcinoma or adenocarcinoma may for example correspond to a bladder, a colon, a kidney, an ovary, a prostate, a lung, an uterus, a breast or a prostate carcinoma or adenocarcinoma. The blastoma may for example correspond to a neuroblastoma, a glioblastoma or a retinoblastoma. The cancer is preferably selected from the group consisting of prostate cancer (e.g. prostate adenocarcinoma), lung cancer (e.g. squamous cellular carcinoma), breast cancer (e.g. infiltrated ductal carcinoma), ovary cancer (e.g. serous papillary carcinoma), uterus cancer (squamous cellular carcinoma), brain cancer (e.g. astrocytoma), colon cancer (e.g. colon adenocarcinoma), colorectal cancer, rectal cancer (e.g. rectal adenocarcinoma), cancer of the striated muscle (e.g. rhabdomyosarcoma), thyroid cancer, testicular cancer. In a most preferred embodiment, the cancer is selected from the group consisting of lung cancer, prostate cancer, ovary cancer, uterus cancer, brain cancer, colon cancer, colorectal cancer, rectal cancer and cancer of the striated muscle, bladder cancer, liver cancer, kidney cancer and thyroid cancer.

By "infectious disease", also known as contagious disease or transmissible disease, is meant any disease which is due to a biological agent which can be spread from one subject to another, i.e. an infectious pathogen. The infectious pathogen may be viruses, bacteria, fungi, protozoa and multicellular parasites.

"Autoimmune disease" is a condition that occurs when the immune system mistakenly attacks and destroys healthy body tissue. Examples of autoimmune (or autoimmune-related) disorders include Addison's disease, Celiac disease—sprue (gluten-sensitive enteropathy), dermatomyositis, Graves disease, Hashimoto's thyroiditis, multiple sclerosis, myasthenia gravis, pernicious anemia, reactive arthritis, rheumatoid arthritis, Sjogren syndrome, systemic lupus erythematosus and type I diabetes.

"Graft rejection" is the rejection of the graft (organs, tissues or cells) by the recipient. The rejection may be based on both cell-mediated and antibody-mediated immunity directed against cells of the graft. The graft may be for instance a xenograft (i.e. tissue that is transplanted from one species to another) or an allograft (i.e. a graft of tissue obtained from a donor genetically different from, though of the same species as the recipient).

"Allergy" or "type 1 hypersensitivity", is a condition characterized by production of allergen-specific IgE in response to a specific allergen, usually a protein. Clinical manifestations and symptoms of allergy may include nasal congestion, nasal pruritis, ocular pruritis, tearing, rhinorrhoea, sinusitis, rhinitis, sneezing, wheezing, conjunctivitis, dermal itching, dermatitis, skin irritation and asthma.

An "allergen" is a substance, usually a protein, which elicits the production of IgE antibodies in predisposed individuals. Allergens may include pollen allergens (such as tree, herb, weed and grass pollen allergens), insect allergens (such as inhalant, saliva and venom allergens, e.g. cockroach, midge and house dust mite allergens and hymenoptera venom allergens), animal hair and dander allergens (from e.g. dog, cat, horse, rat, mouse, rabbit) and food allergens (from e.g. tree nuts, peanut, milk, egg). In a preferred embodiment, the patient has grass pollen allergy and the immunotherapy uses grass pollen allergen.

For instance, a protein allergen may be selected from the group consisting of a protein allergen of the genus *Dermatophagoides*; a protein allergen of the genus *Felis*; a protein allergen of the genus *Ambrosia*; a protein allergen of the genus *Lolium*; a protein allergen of the genus *Cryptomeria*; a protein allergen of the genus *Alternaria*; a protein allergen of the genus *Alder*, a protein allergen of the genus *Betula*; a protein allergen of the genus of *Blomia*; a protein allergen of the genus *Quercus*; a protein allergen of the genus *Olea*; a protein allergen of the genus *Artemisia*; a protein allergen of the genus *Plantago*; a protein allergen of the genus *Parietaria*; a protein allergen of the genus Canine; a protein allergen of the genus *Blattella*; a protein allergen of the genus *Apis*; a protein allergen of the genus *Cupressus*; a protein allergen of the genus *Thuya*; a protein allergen of the genus *Chamaecyparis*; a protein allergen of the genus *Periplaneta*; a protein allergen of the genus *Agropyron*; a protein allergen of the genus *Secale*; a protein allergen of the genus *Triticum*; a protein allergen of the genus *Cynorhodon*; a protein allergen of the genus *Juniperus*; a protein allergen of the genus *Dactylis*; a protein allergen of the genus *Festuca*; a protein allergen of the genus *Poa*; a protein allergen of the genus *Lolium*; a protein allergen of the genus *Avena*; a protein allergen of the genus *Holcus*; a protein allergen of the genus *Anthoxanthum*; a protein allergen of the genus *Arrhenatherum*; a protein allergen of the genus *Agrostis*; a protein allergen of the genus *Phleum*; a protein allergen of the genus *Phalaris*; a protein allergen of the genus *Paspalum*; and a protein allergen of the genus *Sorghum*.

Examples of various known protein allergens derived from some of the above-identified genus include: *Betula* (*verrucosa*) Bet v I; Bet v II; *Blomia* Blo 1 1; Blo t III; Blo t V; Blo t XII; *Cynorhodon* Cyn d I; *Dermatophagoides* (*pteronyssinus* or *farinae*) Der p I; Der p II; Der p III; Der p VII; Der f I; Der f II; Der f III; Der f VII; *Felis* (*domesticus*) Fel d I; *Ambrosia* (*artemiisfolia*) Amb a 1.1; Amb a 1.2; Amb a 1.3; Amb a 1.4; Amb a II; *Lollium* (*perenne*) Lol p I; Lot p II; Lol p III; Lot p IV; Lol p IX (Lol p V or Lol p Ib); *Cryptomeria* (*japonica*) Cry j I; Cry j II; *Canis* (*familiaris*) Can f I; Can f II; *Juniperus* (*sabinoides* or *virginiana*) Jun s I; Jun v I; *Juniperus* (*ashei*) Jun aI; Jun aII; *Dactylis* (*glomerata*) Dae g I; Dae g V; *Poa* (*pratensis*) Poa p I; PhI p I; PhI p V; PhI p VI and *Sorghum* (*halepensis*) Sor h I.

"Immunotherapy" is intended to mean a treatment of disease by inducing, enhancing, or suppressing an immune response by administration of substances (e.g. allergens, immunomodulators such as granulocyte colony-stimulating factor (G-CSF), interferons, imiquimod, cellular membrane fractions from bacteria, cytokines/interleukins (e.g. IL-2, IL-7, IL-12), various chemokines or cells (for instance lymphocytes, macrophages, dendritic cells, natural killer cells (NK Cell), cytotoxic T lymphocytes).

"Vaccine" refers to a pharmaceutical composition comprising an antigen and optionally an adjuvant to stimulate the immune system of an individual to develop adaptive immunity to said antigen. The antigen may for instance be biological agents (for example viruses, bacteria, fungi, protozoa and multicellular parasites) or a peptide therefrom, or a tumoral antigen. Vaccines can be prophylactic (e.g. to prevent or ameliorate the effects of a future infection by the infectious pathogen), or therapeutic (e.g. vaccines against cancer).

The substance used in immunotherapy and the vaccine may be administered via a parenteral route, such as subcutaneously or intravenously, for example via injection, or via alternative routes such as intranasal, skin immunisation e.g. transdermal, epicutaneous, intralymphatic administration or mucosal (administration on mucosal surfaces, e.g. a sublingual, oral, buccal, ocular, rectal, urinal, vaginal, pulmonary or otolar surface).

In relation to allergy, immunotherapy may for example consist of administering an allergen to a patient with the aim of reducing current or future immune response, such as an IgE response, and/or manifestation of clinical symptoms of allergy. Immunotherapy is conventionally carried out by administering repeatedly a monodose or incremental doses of an allergen to a patient in need thereof, thereby resulting in an adaptive immune response of the patient who becomes desensitised to the allergen. Immunotherapy may comprise administration of allergen to a mucosal surface, optionally a sublingual, oral, buccal, ocular, rectal, urinal, vaginal, pulmonary or otolar surface. In particular, immunotherapy may be sublingual immunotherapy. Alternatively, immunotherapy may comprise administration via a parenteral route, such as subcutaneously or intravenously, for example via injection, or via alternative routes such as intranasal, skin immunisation e.g. transdermal, or intralymphatic administration.

The allergen used for immunotherapy may be a single allergenic substance or a mixture of such substances, for example a mixture of proteins. It may be a partially or fully purified extract, such as a pollen extract, a recombinant protein, a hypoallergen or peptide derived therefrom. For example, where the immunotherapy is used to treat grass pollen allergy, the allergen administered for immunotherapy may be a grass pollen extract from pollen of one or several genera of grasses, such as *Dactylis, Poa, Lolium, Anthoxanthum* and *Phleum* genera. The allergen may also be an allergoid, i.e. a chemically modified form of a naturally occurring allergen which has been chemically modified (for example by aldehydation). The allergen may be administered in conjunction with an adjuvant.

"Response" of a patient to treatment indicates that the patient manifests a reduction in the clinical symptoms. Clinical symptoms may be assessed over the course of treatment, i.e. symptoms before treatment may be compared to symptoms during and after treatment. Alternatively, a reduction in symptoms may be determined by comparison to a baseline level established before treatment. Concerning allergy, this approach is particularly useful where, for example, immunotherapy is carried out in patients not currently experiencing symptoms, as may be the case for seasonal grass pollen allergy sufferers, who may be treated before the pollen season. Symptoms may be assessed by standard methods, such as patient self-assessment or record of the amount of medication required. The degree of a patient's response to treatment may be assessed by measuring the degree of reduction of severity in symptoms, for example as described in Example 4 below.

A "responder" subject as defined herein is a subject who responds to immunotherapy or vaccine administration with an improvement in clinical symptoms, preferably a statistically significant improvement as compared to patients receiving placebo or no treatment. Preferably, a responder subject will demonstrate an improvement in clinical symptoms which is greater than the average or median improvement seen in a random sample of subjects.

A "non-responder" subject is a subject who does not manifest any improvement in clinical symptoms following immunotherapy or vaccine administration, or who demonstrates a non-statistically significant improvement in symptoms, or who demonstrates an improvement in clinical symptoms which is less than the average or median improvement seen in a random sample of subjects.

For example, where the allergy is grass pollen allergy, improvement in clinical symptoms may be detected by a reduction in the frequency or severity of nasal congestion, nasal pruritis, ocular pruritis, tearing, rhinorrhoea, sinusitis, rhinitis, sneezing, wheezing and/or conjunctivitis and/or lessening in the uptake of known relief medication.

"Patient" includes any individual who is a candidate for immunotherapy or vaccine, including individuals not currently undergoing therapy.

Concerning allergy, in most cases, the patient will be an individual who has, or has had at any time in the past, clinical symptoms of allergy and/or sensitization to an allergen and/or an allergen-specific IgE response, or an individual at risk of developing such symptoms. Sensitisation to an allergen may be assessed by detecting IgE directed against allergen(s) from this source in the serum of the patient or by skin testing with a preparation containing the corresponding allergen(s). The allergen may without limitation include any of the allergens disclosed herein, in particular a grass pollen allergen.

"Healthy individual" or "healthy donor" denotes a subject who has not previously had an auto-immune disease, an allergy, an infectious disease or a tumor as defined above. A healthy donor also does not otherwise exhibit symptoms of disease. In other words, such donor, if examined by a medical professional, would be characterized as healthy and/or free of symptoms of disease.

All documents referred to herein are hereby incorporated by reference in their entirety.

Throughout the instant application, the term "comprising" is to be interpreted as encompassing all specifically mentioned features as well optional, additional, unspecified ones. As used herein, the use of the term "comprising" also encompasses the embodiment wherein no features other than the specifically mentioned features are present (i.e. "consisting of") as well as the embodiment wherein features other than the specifically mentioned feature are present provided that the essential characteristics of the composition are not materially affected by their presence (i.e. "consisting essentially of").

The present invention will be further illustrated by the following figures and examples which illustrate the characterization of markers of dendritic cell subsets, and their role in assessing the clinical response of patients undergoing anti-allergy immunotherapy. It should be understood however that these examples are given only by way of illustration of the invention and do not constitute in any way a limitation thereof.

BRIEF DESCRIPTION OF THE FIGURES

FIGS. 1 and 2 show that in vitro treatment of MoDCs with LPS, DC2 cocktail or Dex induces pro-inflammatory and tolerogenic MoDCs.

FIG. 1 shows the cytokine production by co-cultures of CD4+ T cells with MoDCs analyzed by using multiplex cytokine quantification assay. Data are shown as means±SEMs (n=12). p values≤0.05 (*), 0.01 () and 0.001 (*) (Wilcoxon test).

FIG. 2 shows the cytokine production by MoDCs analyzed by using multiplex cytokine quantification assay. Data are shown as means±SEMs (n=12). p values≤0.05 (*), 0.01 () and 0.001 (*) (Wilcoxon test).

FIGS. 3-7 shows the validation of DC2 markers by qPCR and flow cytometry. Data are shown as means±SEMs (n=6). p values≤0.05 (*) and 0.01 (**) (Wilcoxon test).

FIG. 3 shows the up-regulated mRNA expression of markers identified by using microarrays by polarized DCs (i.e. Ctrl-DCs, DC1, DC2 and DCreg), analyzed by using qPCR.

FIG. 4 shows the down-regulated mRNA expression of markers identified by using microarrays by polarized DCs (i.e. Ctrl-DCs, DC1, DC2 and DCreg) analyzed by using qPCR.

FIG. 5 shows mRNA expression of markers identified by using label-free MS by polarized DCs (i.e. Ctrl-DCs, DC1, DC2 and DCreg) was analyzed by using qPCR.

FIG. 6 shows mRNA expression of OX40L by polarized DCs (i.e. Ctrl-DCs, DC1, DC2 and DCreg) analyzed by using qPCR.

FIG. 7 shows protein expression of CD141 and OX40L by polarized DCs (i.e. Ctrl-DCs, DC1, DC2 and DCreg) analyzed by flow cytometry. Results are expressed as the mean fluorescence intensity (MFI) obtained with specific antibodies subtracting the signal obtained with the isotype control.

FIG. 8 shows mRNA expression of DCreg markers identified by using microarrays, analyzed by using qPCR.

FIG. 9 shows mRNA expression of DCreg markers identified by using label-free MS, analyzed by using qPCR.

FIG. 10 shows protein expression by polarized MoDCs (i.e. Ctrl-DCs, DC1, DC2 and DCreg) of markers up-regulated in DCreg and analyzed by flow cytometry. Results are expressed as the mean fluorescence intensity (MFI) obtained with specific antibodies subtracting the signal obtained with the isotype control. Data are shown as means±SEMs (n=6).

FIG. 11 shows mRNA expression of CD141, GATA3, OX40L and RIPK4 in PBMCs (AR, n=21; ANR, n=21; PR, n=7; and PNR, n=31 except for RIPK4, AR, n=19 and ANR, n=20). p values≤0.05 (*), 0.01 () and 0.001 (*) (Mann-Whitney test). AR: Active (treated) responder patient; ANR: Active (treated) Non-Responder patient; PR: Placebo Responder patient; PNR: Placebo Non Responder patient.

FIG. 12 shows Spearman correlation of mRNA expression of CD141, GATA3, OX40L and RIPK4 with percentages of ARTSS improvement in patients from the active and placebo groups after 4 months of AIT.

BRIEF DESCRIPTION OF THE TABLES

Figure 1:
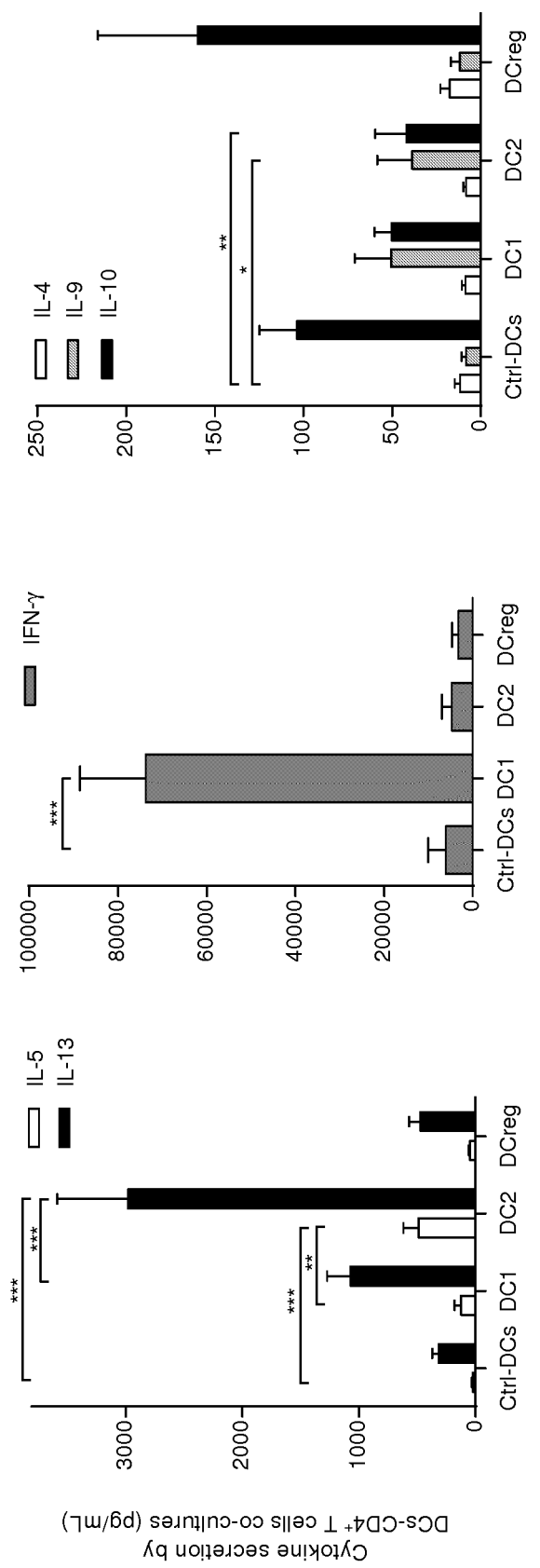

Table 1: Marker proteins used to identify DCreg.
Table 2: Marker proteins used to identify DCreg and DC2.
Table 3: Marker proteins used to identify DC2.
Table 4: Candidate markers identified by using microarrays. Candidate markers identified with a multiple comparison test, a FDR p value≤0.01 and at least a 4-fold change are listed, corresponding to a total of A, 17 sequences up-regulated in DC2, B, 5 sequences down-regulated in DC2 and C, 9 sequences up-regulated in DCreg.
Table 5: Candidate markers identified through the label-free MS approach.
Candidate markers identified with two or more peptides are listed corresponding to a total of A, 4 proteins up-regulated in DC2, B, 1 protein down-regulated in DC2 and C, 18 proteins up-regulated in DCreg (multiple comparison test, FDR p value≤0.01 and fold change≥1.5).
Table 6: Overview of candidate markers for DC2 and DCreg identified through transcriptomic and proteomic approaches, and further validated by qPCR. The know function described in the literature for candidate markers for DC2 or DCreg is summarized.

| Brief description of the sequences | |
|---|---|
| SEQ ID NO: | Description |
| 1-3 | Amino acid sequences of DAB2 isoforms |
| 4-5 | Amino acid sequences of FcγRIIa isoforms |
| 6 | Amino acid sequence of FTL |
| 7-12 | Amino acid sequences of PECAM1 isoforms |
| 13-16 | Amino acid sequences of SLCO2B1 isoforms |
| 17 | Amino acid sequence of C3AR1 |
| 18-21 | Amino acid sequences of CD163 isoforms |
| 22-27 | Amino acid sequences of CD300LF isoforms |
| 28-29 | Amino acid sequences of CFH isoforms |
| 30-32 | Amino acid sequences of CSGALNACT1 isoforms |
| 33 | Amino acid sequence of P2RY14 |
| 34-35 | Amino acid sequences of ZBTB16 isoforms |
| 36-38 | Amino acid sequences of FcγRIIB isoforms |
| 39 | Amino acid sequence of CYP1B1 |
| 40-41 | Amino acid sequences of DPYD isoforms |
| 42 | Amino acid sequence of GCLC |
| 43 | Amino acid sequence of IVNS1ABP |
| 44 | Amino acid sequence of LRRC25 |
| 45-48 | Amino acid sequences of NUDT16 isoforms |
| 49-50 | Amino acid sequences of PDCD4 isoforms |
| 51 | Amino acid sequence of RNASE6 |
| 52-53 | Amino acid sequences of RNASET2 isoforms |
| 54 | Amino acid sequence of FcγRIIIa |
| 55 | Amino acid sequence of C1QA |
| 56 | Amino acid sequence of FcεRIG |
| 57-61 | Amino acid sequences of MCTP1 isoforms |
| 62 | Amino acid sequence of SIGLEC5 |
| 63-64 | Amino acid sequences of GATA3 isoforms |
| 65-66 | Amino acid sequences of RIPK4 isoforms |
| 67 | Amino acid sequence of CALCA |
| 68-96 | Amino acid sequences of CREM isoforms |
| 97 | Amino acid sequence of FMOD |
| 98 | Amino acid sequence of HCRTR1 |
| 99 | Amino acid sequence of ILDR2 |
| 100 | Amino acid sequence of ITK |
| 101-102 | Amino acid sequences of PADI2 isoforms |
| 103-114 | Amino acid sequences of PDE4D isoforms |
| 115-116 | Amino acid sequences of PNOC isoforms |
| 117-121 | Amino acid sequences of RGS9 isoforms |
| 122-124 | Amino acid sequences of ROR1 isoforms |
| 125 | Amino acid sequence of SIX2 |

-continued

| Brief description of the sequences | |
|---|---|
| SEQ ID NO: | Description |
| 126-127 | Amino acid sequences of SYT4 isoforms |
| 128-129 | Amino acid sequences of THBS1 isoforms |
| 130-132 | Amino acid sequences of TRIM9 isoforms |
| 133-135 | Amino acid sequences of ADAM8 isoforms |
| 136-137 | Amino acid sequences of CYTIP isoforms |
| 138-143 | Amino acid sequences of NRP2 isoforms |
| 144-145 | Amino acid sequences of SEMA7A isoforms |
| 146-148 | Amino acid sequences of TBC1D13 isoforms |
| 149-150 | Amino acid sequences of OX40L isoforms |
| 151 | Amino acid sequence of CD141 |
| 152 | Amino acid sequence of C1QB |
| 153 | Amino acid sequence of C1QC |
| 154-261 | Amino acid sequences of peptides of Table 5 |

EXAMPLES

Example 1: Polarization of Monocytes Derived DCs Towards DC2 and/or DCreg

This example describes a method for the polarization of MoDCs towards DC2 and/or DCreg.

Materials and Methods

DC Generation and In Vitro Stimulation

Human PBMCs from healthy donors obtained at "Etablissement Français du Sang" (Rungis, France) were separated from fresh buffy coats of by centrifugation over a lymphocytes separation medium (Eurobio AbCys, Courtaboeuf, France). $CD14^+$ monocytes were purified from the mononuclear fraction by magnetic cell sorting, using microbead-conjugated with anti-CD14 antibodies (MACS; Miltenyi Biotec, Bergisch Gladbach, Germany) and an autoMACS Pro Separator (Miltenyi Biotec), resulting in more than 95% purity of $CD14^+$ cells. To generate monocyte-derived DCs (MoDCs), $CD14^+$ monocytes were cultured ($6 \times 10^5$ cells/ml) for 6 days at 37° C. in humidified air containing 5% $CO_2$, in RPMI 1640 medium with stable glutamine supplemented with 10 μg/ml Gentamicin, 50 μM 2-ME, 1% nonessential amino acids (all obtained from Invitrogen, Carlsbad, Calif.), and 10% fetal calf serum (FCS, PAA Laboratories, Les Mureaux, France), in presence of human rGM-CSF and rIL-4 (Miltenyi Biotec) using 125 and 75 ng/ml concentrations, respectively. One fifth of the amount of medium with cytokines was added after 4 days. On day 6, a pure population of MoDCs was obtained, with 98% $CD14^- CD1a^+ CD11c^+$ and maximum 0.5% $CD3^+$ cells detected by flow cytometry using a FACSVerse cytometer (BD Biosciences, Le Pont de Claix, France) and the FlowJo analysis software (Treestar). Up to $1 \times 10^6$ MoDCs were plated in a 24-well plate in presence of medium for Ctrl-DCs or treated with Dexamethasone (Dex, 1 μg/ml; Sigma-Aldrich, St. Louis, Mo.) for DCreg, with highly purified lipopolysaccharide (LPS) from *Escherichia coli* (1 μg/ml; Sigma-Aldrich) for DC1 or with a mix composed of Histamine (10 μM; Sigma-Aldrich), IL-25 (100 ng/ml; R&D Systems, Minneapolis, Minn.), IL-33 (100 ng/ml; R&D Systems), LPS (10 ng/ml; Sigma-Aldrich), Prostaglandin E2 (PGE2, 10 μM; Sigma-Aldrich), Thymic Stromal Lymphopoietin (TSLP, 100 ng/ml; R&D Systems) for DC2, for 24 h at 37° C. and 5% $CO_2$.

MoDCs/T-Cells Co-Cultures

For MoDCs/T-cells co-cultures experiments, treated MoDCs were washed twice with medium and cultured in a 48-well plate with allogeneic $CD4^+$ naive T cells at a 1:10

MoDCs/T cells ratio for 5 days. Naive CD4+ T cells were isolated from PBMCs by negative selection using the MACS naive CD4 isolation kit II (Miltenyi Biotec), according to the manufacturer's instructions. Such naive T cells were confirmed to have purity greater than 95% based on CD4 and CD45RA expression evaluated by flow cytometry.

Analysis of Cytokine Production

Cytokine measurement was performed in supernatants collected 24 h after treatment of MoDCs using multiplex cytokine quantification assays. IFN-γ, IL-4, IL-5, IL-6, IL-8, IL-9, IL-10, IL-12p70, IL-13, and TNF-α were measured using the Milliplex MAP human kit Cytokine/Chemokine Magnetic Bead Panel (Millipore, Le Pont de Claix, France) and analyzed using an MagPix Luminex xMAP technology (Millipore).

Results

The inventors defined optimal culture conditions inducing the polarization of immature monocytes derived DCs (MoDCs) toward DC2, capable to promote the differentiation of naive CD4+ T cells toward Th2 cells (IL-5 and IL-13 secreting cells). After screening several biological and pharmaceutical agents, they selected a mixture of molecules, subsequently termed "DC2 cocktail", capable of polarizing MoDCs toward DC2. Immature MoDCs (Ctrl-DCs), MoDCs treated with LPS (DC1) and MoDCs treated with Dex (DCreg) were used as benchmarkers to compare with DC2.

The polarization of naive allogeneic CD4+ T cells co-cultured for 5 days with polarized MoDCs (12 independent donors) was analyzed by evaluating cytokine levels in culture supernatants, as a read-out of DCs functional polarization. As expected, CD4+ T cells co-cultured with DC1 and DCreg produced high levels of IFN-γ and IL-10, respectively, when compared to Ctrl-DCs (FIG. 1). Markedly, DC2 promoted the differentiation of IL-5 and IL-13 secreting CD4+ T cells while preventing the production of IFN-γ and IL-10, thus confirming the bona fide type 2 profile of these cells.

The inventors further characterized the pattern of cytokine secreted by DC2 in comparison with other MoDC subsets. As previously reported (Zimmer et al. (2011) *J. Immunol.* 186:3966-3976), DCreg did not induce any pro-inflammatory cytokines when compared to Ctrl-DCs (FIG. 2). In contrast, DC1 expressed high levels of the Th1-inducing cytokine IL-12p70, increased inflammatory cytokines (IL-6, IL-8, IL-10, and TNF-α) and Th1 cytokines (IFN-γ) in comparison with Ctrl-DCs. DC2 expressed high levels of IL-13 and also secreted some inflammatory cytokines such as IL-6, IL-8, IL-10 and TNF-α. Noticeably, DC2 significantly increased Th2 (IL-13) while decreasing Th1 (IL-12p70 and IFN-γ) driving cytokines when compared to DC1.

Collectively, those experiments confirm that the "DC2 cocktail" is able to generate bona fide type 2 MoDCs which express effector genes, produce specific inflammatory cytokines (i.e. IL-6, IL-8, IL-10, IL-13 and TNF-α) and promote the differentiation of Th2 (IL5+ IL13+ IFN-γ−) CD4+ T cells.

Example 2: Identification of Molecular Markers for DC2

This example describes the identification of novel molecular markers for CD2.

Materials and Methods

RNA Preparation and Microarray Analysis of MoDC Types

Polarized MoDCs were harvested 24 h after treatment as described in Example 1, washed in PBS. Total RNA from MoDCs was isolated using standard RNA extraction protocols miRNeasy Mini Kit (Qiagen, Courtaboeuf, France). RNA samples were quality-checked via the Agilent 2100 Bioanalyzer platform (Agilent Technologies, Waldbronn, Germany). For the linear T7-based amplification step, 100 ng of each total RNA sample was used. To produce Cy3-labeled cRNA, the RNA samples were amplified and labelled using the Agilent Low Input Quick Amp Labeling Kit (Agilent Technologies) following the manufacturer's protocol. After quantification of the dye incorporation, labelled cRNA samples were hybridized according to the Agilent 60-mer oligo microarray process in protocol using the Agilent Gene Expression Hybridization Kit (Agilent Technologies). 600 ng of Cy3-labeled fragmented cRNA in hybridization buffer was hybridized overnight (17 h, 65° C.) to Agilent Whole Human Genome Oligo Microarrays 8×60K V2 using Agilent's recommended hybridization chamber and oven. The microarrays were washed once with the Agilent Gene Expression Wash Buffer 1 for 1 min at room temperature followed by a second wash with preheated Agilent Gene Expression Wash Buffer 2 (37° C.) for 1 min. Fluorescence signals of the hybridized Agilent Microarrays were detected using Agilent's Microarray Scanner System (Agilent Technologies). Raw microarray image data were extracted and analyzed with the Agilent Feature Extraction Software. The software determines feature intensities (including background subtraction), rejects outliers and calculates statistical confidences. The signal intensities form the single-experiment raw data lists are normalized by dividing the intensity values by their median.

After background correction, quantile normalization was conducted between arrays. Finally, the normalized intensities were log 2-transformed and served as basis for further analysis. A combination of statistical and non-statistical analyses was conducted in order to identify genes differentially expressed between the four groups (Ctlr-DCs, DC1, DC2 and DCreg). In the first step of the statistical analyses, ANOVA tests with repeated measurements design were applied to evaluate differences between all sample groups. To correct for type I error, the Benjamini-Hochberg multiple testing correction method was applied. As rule of thumb, statistically significant changes in expression are usually considered for reporters with adjusted p-values of less than or equal to 0.05. However, since very many significant records remained after p-value correction the threshold was set to adjusted p-values≤0.01 in the first round of selection of differentially expressed genes. The second evaluation for expression differences between one particular MoDCs sample group relative to the control group occurred by Tukey's post-hoc test. Significant differences were considered for Tukey p-value≤0.01. The statistical tests were complemented by a non-statistical quantification of the median fold change between the two groups. A cut-off of at least 4-fold differential expression was applied.

Label-Free Mass Spectrometry Analysis of MoDC Types

Polarized MoDCs were washed twice with PBS and cell pellets were harvested and lysed in buffer containing 6 M urea, 2 M thiourea, 0.15% ProteaseMax, 5 mM TCEP, 20 mM Trix pH 8.5 and 24 mM spermine (all obtained from Sigma). Proteins were then quantified using a Bradford assay (Biorad) and fractionated over 4-12% gradient precast gel (NuPAGE, Invitrogen) to control quality. 100 μg of proteins were digested with Lys-C (37° C., 3.5 h, enzyme/substrate ratio of 1/50, Sigma) and with trypsin (25° C., overnight, enzyme/substrate ratio of 1/20) and the digestion was stopped with 2.8% FA. After centrifugation (25 000 g, 10 min, 20° C.), supernatants were collected and stored at −80° C.

NanoLC-MS analysis was accomplished using the nanoLC Q-Exactive (Thermo Fisher) coupled to a nano-UPLC RSLC Ultimate 3000 (Dionex). 1000 ng of tryptic peptides were injected (6 µl) and trapped for 10 min with a flow rate of 12 µl/min (2% ACN, 0.15% FA). Separation was then performed using a C18 column (75 µm—50 cm, $C_{18}$, 3 µm) with a flow rate of 270 nl/min, two linear gradient segments (4-27% $H_2O$/ACN for 130 min, 27-50% $H_2O$/ACN for 38 min) and holding at 95% $H_2O$/ACN for a further 8 min before returning to 4% $H_2O$/ACN for 18 min. The data were acquired with a nano-UPLC RSLC Ultimate 3000. Ion intensities recorded in LC-MS data were analyzed using Progenesis LC-MS v3.1 software (nonlinear Dynamics) to provide reliable measurements of peptide abundance across samples. Data were then normalized by the "normalize to all features" method and comparison between the four groups (obtained Ctlr-DCs, DC1, DC2 and DCreg) was performed to choose which peptides were statistically differentially represented (FDR p-value≤0.01 and fold change≥1.5).

RNA Isolation and Quantitative Real-Time PCR Analysis

Total RNA was extracted from treated MoDCs, PBMCs or subsets of PBMCs using the RNeasy Mini kit and the Qiacube robot (Qiagen), and cDNAs were synthesized using TaqMan reverse transcription reagents (Applied Biosystems, Les Ulis, France) as per the manufacturer's instructions. mRNA expression was evaluated by quantitative PCR on a 7900HT Real-Time PCR system (Applied Biosystems) with predesigned TaqMan gene expression assays and reagents, according to the manufacturer's instructions. Expression of the following genes was assessed in DCs or PBMCs: ADAM8 (Hs00923290_g1), C1QA (Hs00381122_m1), C3AR1 (Hs00269693_s1), CALCA (Hs01100741_m1), CD141 (Hs00264920_s1), CD163 (Hs00174705_m1), CD300LF (Hs00371178_m1), CFH (Hs00962373_m1), CREM (Hs01590456_m1), CSGALNACT1 (Hs00218054_m1), CYP1B1 (Hs02382919_s1), CYTIP (Hs00976346_m1), DAB2 (Hs01120074_m1), DPYD (Hs0055279_m1), FCER1G (Hs00175408_m1), FCGRIIA (Hs01017702_g1), FCGR2B (Hs01634996_s1), FCGRIIIA (Hs02388314_m1), FMOD (Hs00157619_m1), FTL (Hs00830226_gH), GATA3 (Hs00231122_m1), GCLC (Hs00155249_m1), HCRTR1 (Hs00173513_m1), ILDR2 (Hs01025498_m1), ITK (Hs00950634_m1), IVNS1ABP (Hs01573482_m1), LRRC25 (Hs01029557_m1), MCTP1 (Hs00381047_m1), NRP2 (Hs00187290_m1), NUDT16 (Hs001292234_m1), OX40L (Hs00182411_m1), P2RY14 (Hs01848195_s1), PADI2 (Hs00247108_m1), PDCD4 (Hs00377253_m1), PDE4D (Hs01579625_m1), PECAM1 (Hs0016977_m1), PLEKHAS (Hs00219251_m1), PNOC (Hs00918595_m1), RGS9 (Hs00187172_m1), RIPK4 (Hs01062501_m1), RNASE6 (Hs00271608_s1), RNASET2 (Hs00427770_m1), ROR1 (Hs00938677_m1), SEMA7A (Hs01118876_g1), SIX2 (Hs00232731_m1), SLCO2B1 (Hs01030343_m1), SIGLEC5 (Hs00174659_m1), SYT4 (Hs01086433_m1), TBC1D13 (Hs00217055_m1), THBS1 (Hs00962908_m1), TRIM9 (Hs00364838_m1), and ZBTB16 (Hs00957433_m1). Data were interpreted for each target gene in comparison with endogenous β-actin (Hs99999903 m1) as a control. The relative amount of target genes in each sample was calculated in comparison with the calibrator sample (unstimulated cells or PBMCs before treatment) using the $\Delta\Delta$ cycle threshold (Ct) method. The magnitude of gene induction was calculated using the equation $2^{-\Delta\Delta Ct}=2^{-(\Delta Ct \text{ for stimulated cells}-\Delta Ct \text{ for unstimulated cells})}$ or $2^{-\Delta\Delta Ct}=2^{-(\Delta Ct \text{ for PBMCs after treatment}-\Delta Ct \text{ for PBMCs before treatment})}$.

Results

Two different approaches were used to identify specific DC2 markers.

Firstly, whole genome mRNA expression analysis was conducted in Ctrl-DCs, DC1, DC2 and DCreg generated from peripheral blood monocytes of 6 independent donors, as described in Example 1, by using microarrays covering 50 684 sequences. When compared to Ctrl-DCs, DC2 up- and down-regulated 1493 and 1882 genes, respectively, with a p value≤0.01 and a minimum fold change of 4. Interestingly, when compared to all experimental groups (i.e. Ctrl-DCs, DC1 and DCreg) 98 and 25 sequences were specifically over- and under-expressed, respectively, in DC2 (Table 4, A-B).

The inventors subsequently investigated differences in protein expression between polarized DCs by using label-free MS-based approaches. Differentially regulated peptides were fragmented in MS/MS mode, leading to the identification of proteins further matched to sequence databases (Mascot and Peaks). Up to 556 and 538 proteins were identified with Mascot and Peaks, respectively (with FDR p value≤0.01, a fold increase of minimum 1.5 [multiple comparison test] and peptide number≥2). Markedly, 24 and 7 of those proteins were significantly up- and down-regulated, respectively, in DC2 when compared to all experimental groups (i.e. Ctrl-DCs, DC1 and DCreg) as summarized in Table 5, A-B.

Figure 3:
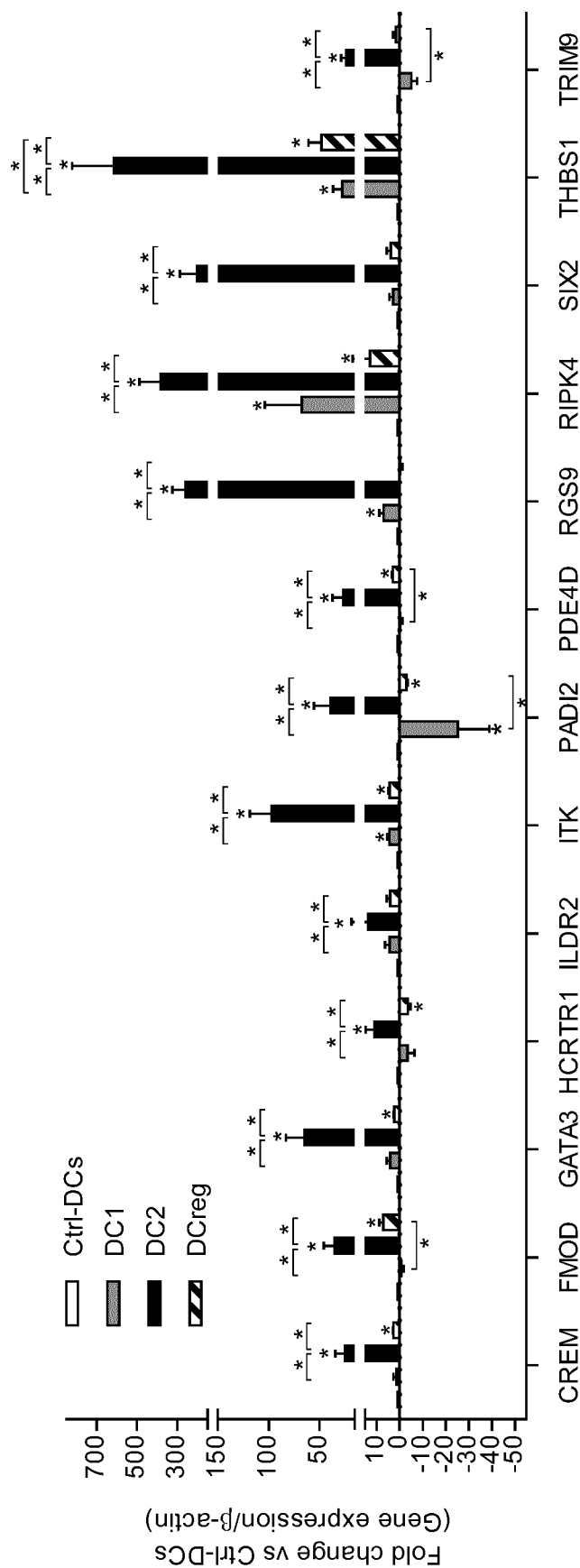
Figure 4:
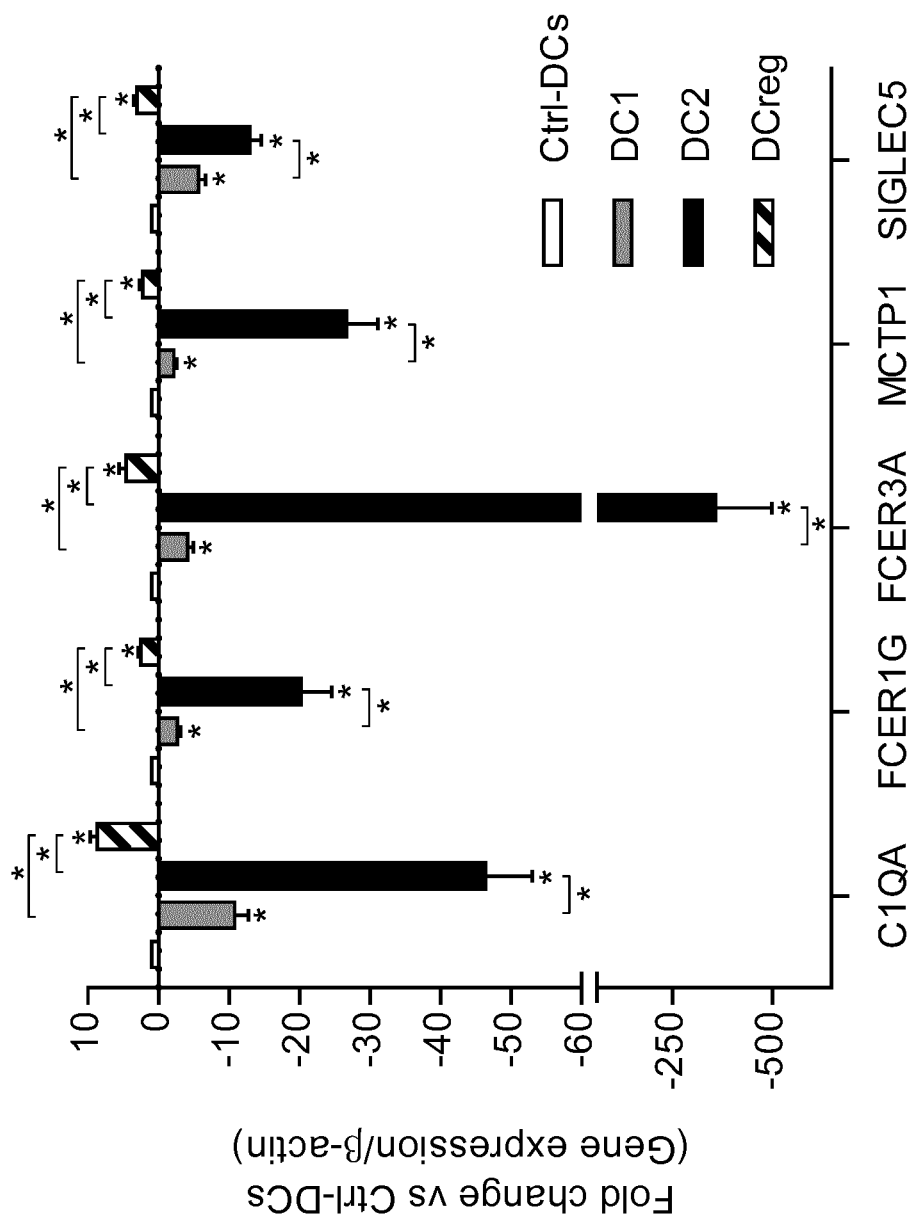

To validate these findings, the inventors selected 31 candidate markers specific of DC2 identified by microarrays analyses, based on their fold change 17) and/or their relevance in allergy and tolerance, and assessed their expression by qPCR. Interestingly, 17 genes markers were confirmed to be strongly up-regulated in DC2 when compared to Ctrl-DCs. 4 of them (i.e. CALCA, PNOC, ROR1 and SYT4) were only amplified in DC2 conditions while the remaining 13 (i.e. CREM, FMOD, GATA3, HCRTR1, ILDR2, ITK, PADI2, PDE4D, RGS9, RIPK4, SIX2, THBS1 and TRIM9) exhibited a greater than 11-fold increase in DC2 when compared to Ctrl-DCs (FIG. 3 and Table 6A). As well, 5 markers (i.e. C1QA, FcεRIG, FcγRIIIA, MCTP1 and SIGLEC5) were shown to be under-expressed in DC2 while being over-expressed in DCreg (FIG. 4 and Table 6B). Additionally, as GATA3, ITK and TRIM9 are highly expressed by T cells (bioGPS database), DC2 were sorted after stimulation, to exclude that the up-regulation of these genes was due to potential contaminating $CD3^+$ T cells. Noteworthy, the up-regulation of GATA3, ITK and TRIM9 was confirmed in ultrapure DC2 (>99.9% $CD1a^+$ $CD11c^+$ $CD3^-$) whereas the expression of two specific markers for T cells (i.e. CD3 and CD2) could not be detected by using qPCR, thus confirming that residual $CD3^+$ T cells were absent.

Figure 5:
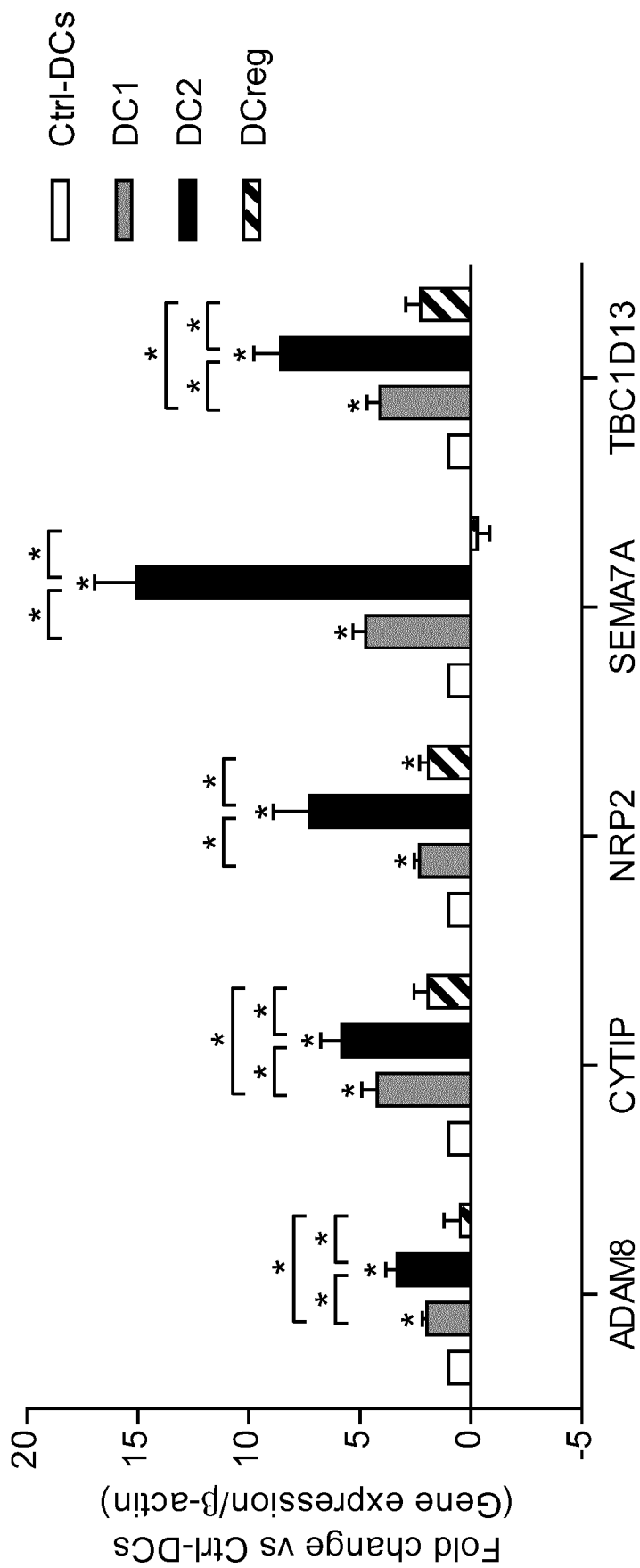

Proteins identified by label-free MS were also validated by using qPCR. As shown in FIG. 5, the expression of genes encoding ADAM8, CYTIP, NRP2, SEMA7A and TBC1D13 was significantly increased in DC2 when compared to Ctrl-DCs.

In addition, the expression of OX40L (TNSFS4) and CD141 (thrombomodulin or blood dendritic cell antigen 3) was also assessed in DC2. As shown in FIGS. 6 and 7, up-regulation of OX40L in DC2 was validated by qPCR and flow cytometry analyses whereas up-regulation of the CD141 protein was only confirmed by flow cytometry.

Altogether, experiments conducted using these two different approaches led to the identification of several markers specific of the DC2 subset which are either over-expressed (i.e. ADAM8, CALCA, CD141, CREM, CYTIP, FMOD, GATA3, HCRTR1, ILDR2, ITK, NRP2, PADI2, PDE4D, PNOC, OX40L, RGS9, RIPK4, ROR1, SEMA7A, SIX2, SYT4, TBC1D13, THBS1 and TRIM9), or under-expressed (i.e. C1QA, FcεRIG, FcγRIIIA, MCTP1, SIGLECS), respectively, when compared to Ctrl-DCs. The known function of each of those DC2 specific markers is summarized in Tables 2 and 3.

Example 3: Identification of Molecular Markers for DCreg

This example shows the identification of new molecular markers for DCreg.
Materials and Methods
RNA Preparation and Microarray Analysis of MoDC Types
RNA preparation and microarray analysis was performed as described in Example 2.
Label-Free Mass Spectrometry Analysis of MoDC Types
Label-free mass spectrometry analysis was performed as described in Example 2.
RNA Isolation and Quantitative Real-Time PCR Analysis
RNA isolation and quantitative real-time PCR analysis was performed as described in Example 2.
Results To identify new markers specific to DCreg, the inventors similarly took advantage of microarrays and label-free MS results from the comparison of mRNA and protein expression in Ctrl-DCs, DC1, DC2 and DCreg. When using criteria similar to these described for the identification of specific DC2 markers in Example 2, 115 genes and 20 proteins were specifically up-regulated in tolerogenic DCs when compared to all experimental groups (i.e. Ctrl-DCs, DC1 and DC2) (Table 4C and Table 6C). Furthermore, 5 proteins (i.e. C1QA, C1QB, C1QC, FKBP5 and STAB1) identified in a previous study (Zimmer et al. (2012) *J. Allergy Clin. Immunol.* 129:1020-1030), were confirmed to be over-expressed in DCreg with this proteomic analysis. Interestingly, these two approaches (i.e. microarray and label-free MS) confirmed the up-regulation of FcγRIIA and FcγRIIB.

Figure 8:
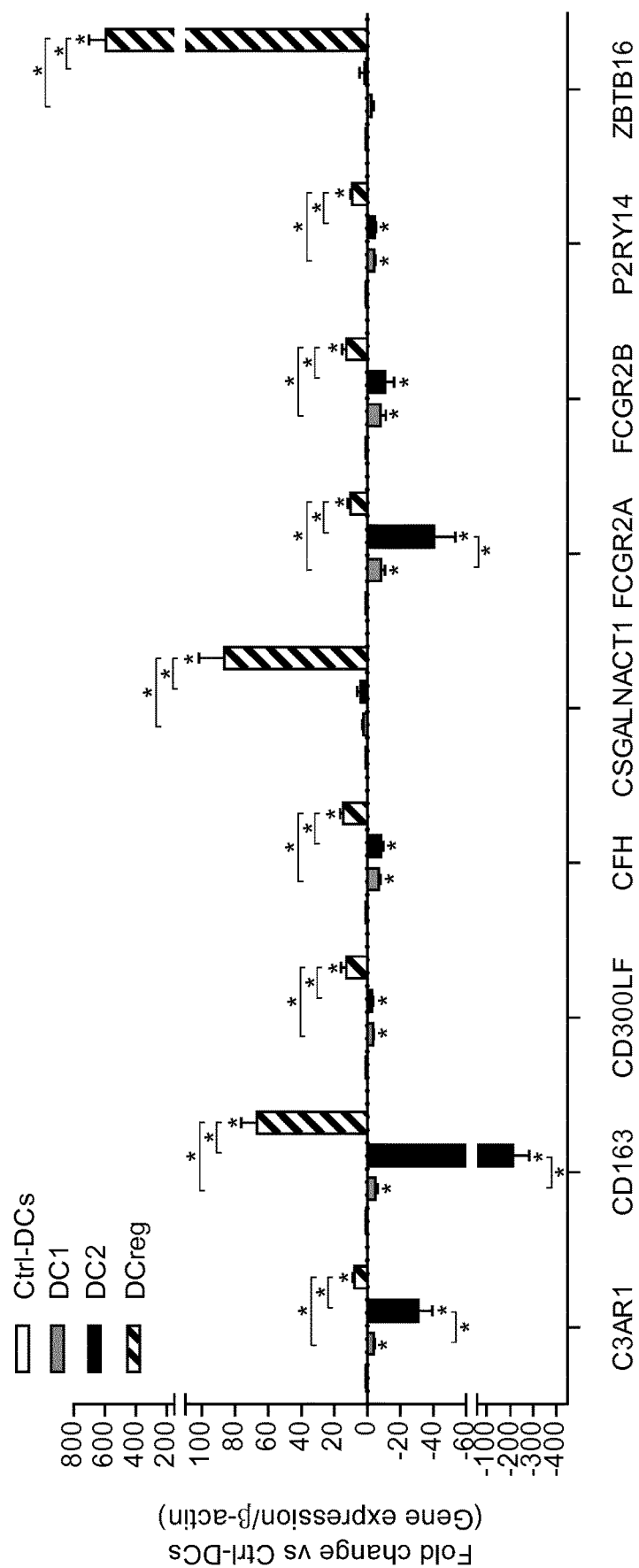
FIG. 8-10 shows the validation of DCreg markers by qPCR and flow cytometry. Data are shown as means±SEMs (n=6). p values≤0.05 (*) and 0.01 (**) (Wilcoxon test).
Figure 9:
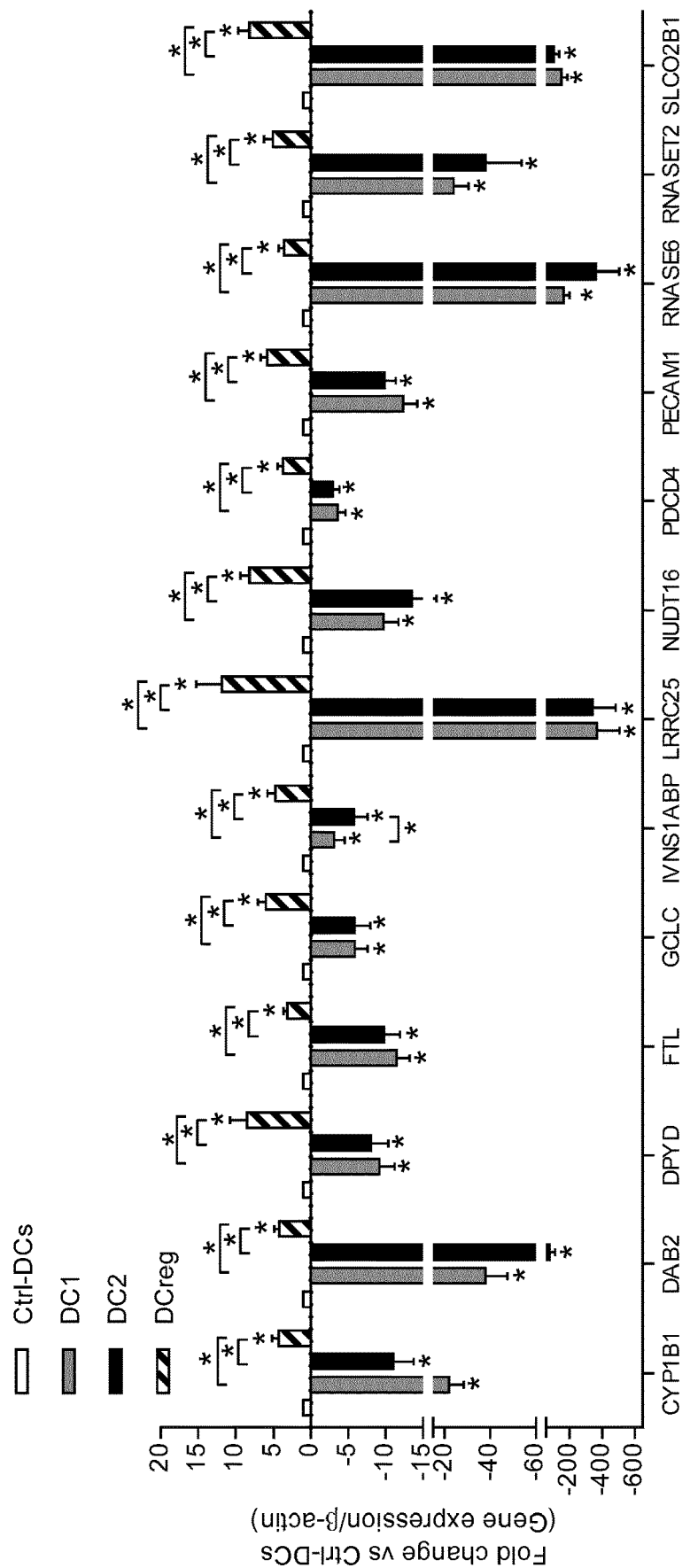
Figure 10:
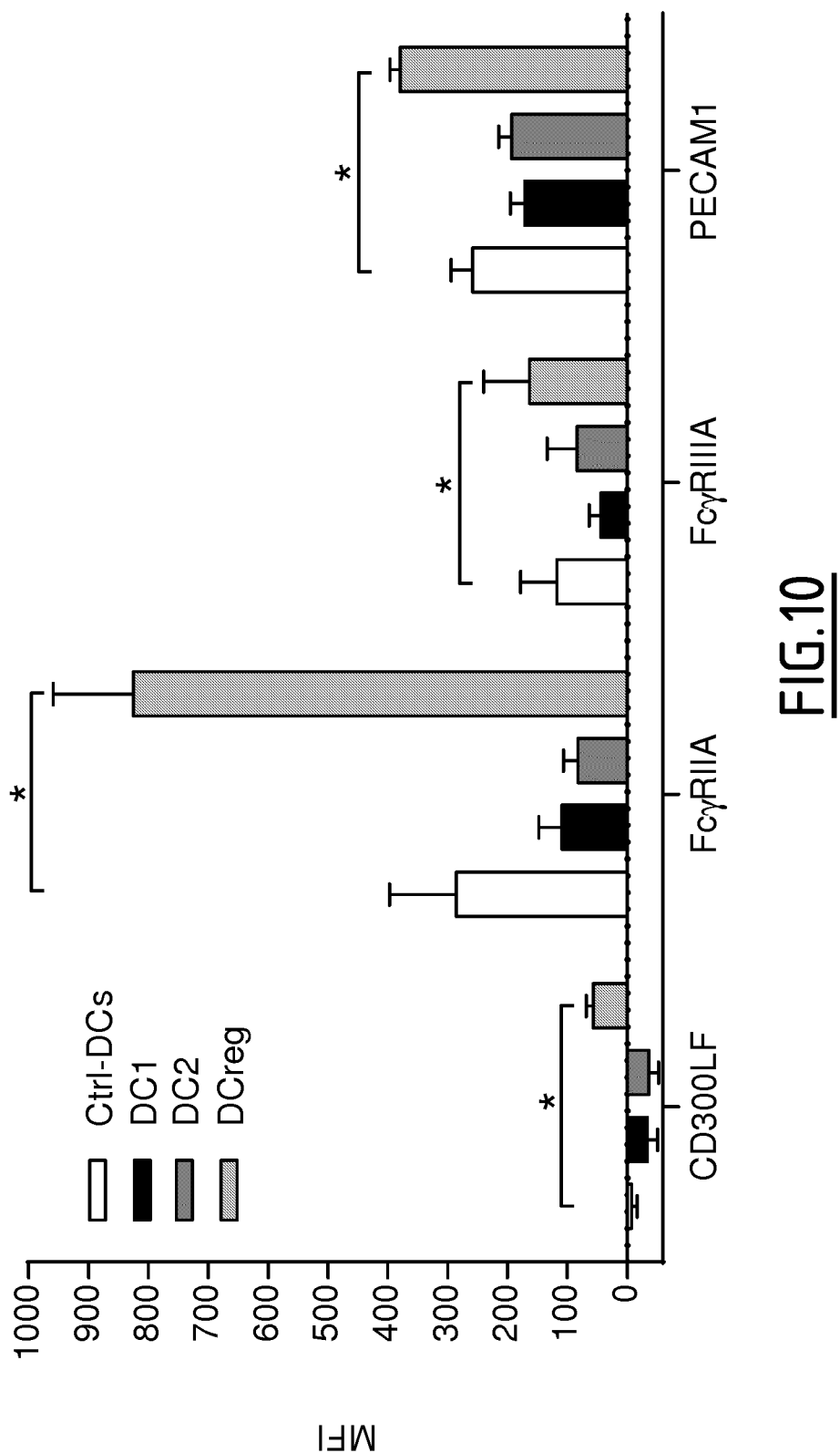

To validate these findings, the inventors selected 10 candidate markers specific of DCreg identified by microarrays analyses based on their fold change 4.5) and/or their relevance in tolerance, and assessed their expression by using qPCR. Among the 10 markers selected, 9 of them (i.e. C3AR1, CD163, CD300LF, CFH, CSGALNACT1, FcγRIIA, FcγRIIB, P2RY14 and ZBTB16) were confirmed to be significantly up-regulated in DCreg and interestingly, 7 of them (i.e. C3AR1, CD163, CD300LF, CFH, FcγRIIA, FcγRIIB, and P2RY14) were down-regulated in DC2 when compared to Ctrl-DCs (FIG. 8). Proteins identified by label-free MS were also validated by using qPCR (FIG. 9). Markedly, the expression of genes encoding CYP1B1, DAB2, DPYD, FTL, GCLC, IVNS1ABP, LRRC25, NUDT16, PDCD4, PECAM1, RNASE6, RNASET2 and SLCO2B1 was significantly increased in DCreg and decreased in DC1 and DC2. The inventors next performed validation experiments by using flow cytometry analyses and the up-regulation of CD300LF, FcγRIIIA, FcγRIIA and PECAM1 expression was also detected at the MoDCs cell surface (FIG. 10). Together, these two distinct analytic methods led to the identification of several new markers for tolerogenic DCs (i.e. C3AR1, CD163, CD300LF, CFH, CSGALNACT1, CYP1B1, DAB2, DPYD, FcγRIIA, FcγRIIB, FTL, GCLC, IVNS1ABP, LRRC25, NUDT16, P2RY14, PDCD4, PECAM1, RNASE6, RNASET2, SLCO2B1 and ZBTB16).

Example 4: Assessment of Specific Markers for DC2 and DCreg in PBMCs from Patients Undergoing Successful AIT Materials and Methods
Clinical Samples from the VO56.07A Pollen Chamber Study Details of the double-blind, placebo-controlled clinical trial V056.07A (ClinicalTrials.gov NCT00619827) have been published in (Horak et al. (2009) *J. Allergy Clin. Immunol.* 129:471-477). Briefly, after the randomization visit (V3), 89 grass pollen allergic patients received sublingually a daily grass pollen tablet (Stallergenes SA, Antony, France) or a placebo for 4 months. Patients were treated outside of the pollen season and exposed to grass pollens in an allergen challenge chamber (ACC) at baseline (V3), after 1 week (V4), 1 (V5), 2 (V6) and 4 (V7) months. Percentages of improvement of Average Rhinoconjunctivitis Total Symptom Score (ARTSS) were calculated between baseline and each challenge for all individuals patients. The median of percentages of ARTSS improvement in the active group (corresponding to at least a 43.9% decrease of ARTSS at V7, i.e after treatment) was considered as a threshold to define responder and nonresponder patients. As a result, the inventors classified patients in 4 subgroups including active responders (AR), active nonresponders (ANR), placebo responders (PR) and placebo nonresponders (PNR). Analysis of DC markers was perform on samples collected at baseline (V3), after 2 (V6) and 4 (V7) months of immunotherapy from 80 patients (n=42 from active group and n=38 for placebo group). PBMCs were processed as previously described [2] and used for RNA isolation and PCR analysis. All samples were coded and all biological analyses reported herein were conducted in a blind manner by the operators.
RNA Isolation and Quantitative Real-Time PCR Analysis
RNA isolation and quantitative real-time PCR analysis was performed as described in Example 2.
Statistical Analysis Data are expressed as mean±SEM. Stastistical differences between groups were assessed by using 2-tailed nonparametric tests: Wilcoxon and Mann-Whitney test for paired or independent data, respectively. Treatments were compared with controls and P values of less than 0.05 were considered significant. Correlation analyses were performed by using the nonparametric Spearman test, and receiver operating characteristic (ROC) analyses were assessed by using an empiric model. Statistical and graphic analyses were performed with Prism6 software (GraphPad Software, Inc, La Jolla, Calif.). ROC analyses of combination of markers were performed with mROC program (Kramar 2001).
Results The inventors investigated a potential shift from effector to tolerogenic DC markers during AIT. To this aim, they assessed the expression of genes encoding the markers of the invention in PBMCs collected from 80 grass pollen allergic patients before (V3), and after 2 (V6) and 4 (V7) months of sublingual AIT. In addition, the expression of C1QA was monitored in these patients as a positive control because its expression was already shown to increase after AIT in a previous study in the active group, among responders (AR) (Zimmer et al. (2012) *J. Allergy an. Immunol.* 129:1020-1030).

In a first set of experiments, all selected genes encoding for DC2 markers (24 markers) and for DCreg markers (29 markers) were first assessed by using qPCR in a subgroup of 23 patients. Strikingly, the expression of several DC2 markers (i.e. CD141, ITK, GATA3, OX40L, RIPK4 and TBC1D13) decreased in the active group and specifically in the AR group, whereas the expression of several DCreg markers (i.e. C1QA, CD163, CD300LF, DAB2, FcγRIIA, FcγRIIIA, FTL, LRRC25, PECAM1, SLCO2B1 and RNASE6) rather increased. These candidate markers were then selected to assess the polarization of peripheral blood DCs in the whole cohort (n=80 patients).

Figure 11:
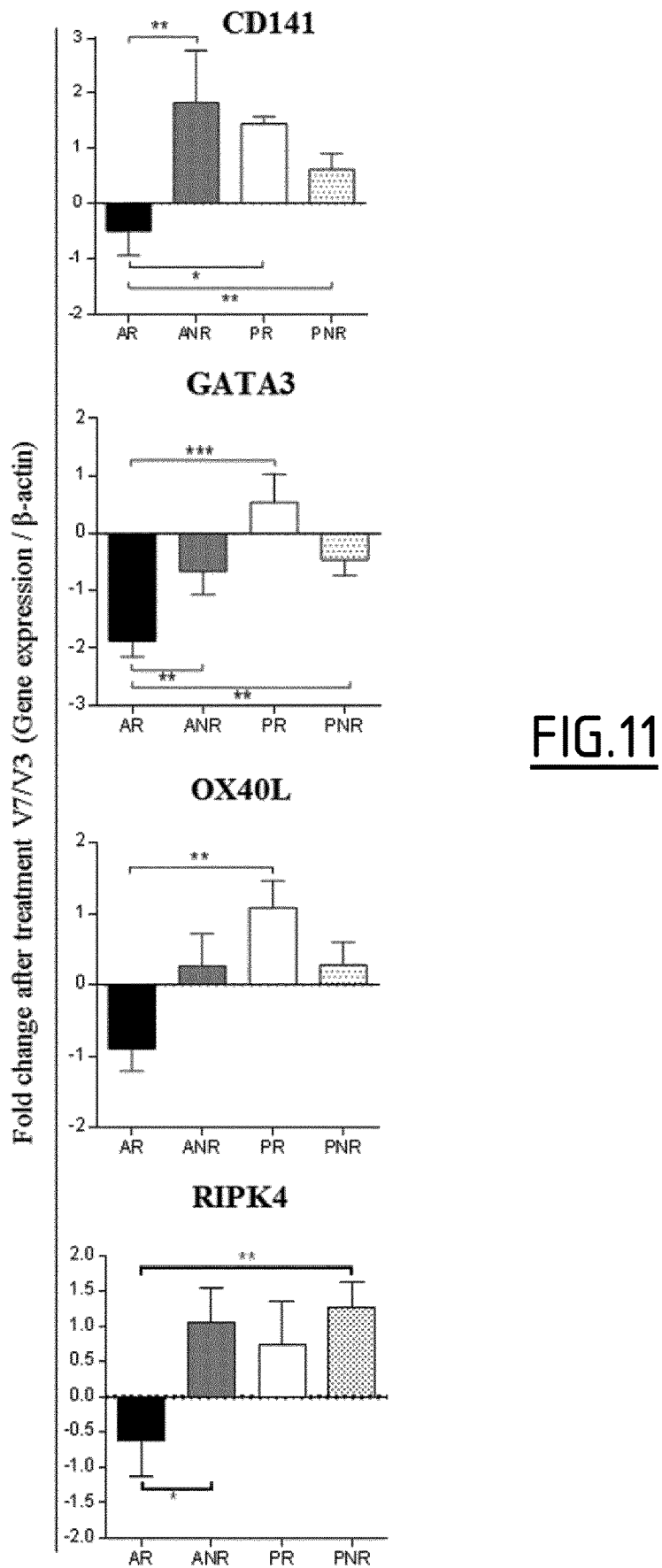
FIGS. 11-12 show the decrease of CD141, GATA3, OX40L and RIPK4 genes in PBMCs from patients with grass pollen allergy receiving AIT after 4 months of treatment.
Figure 12:
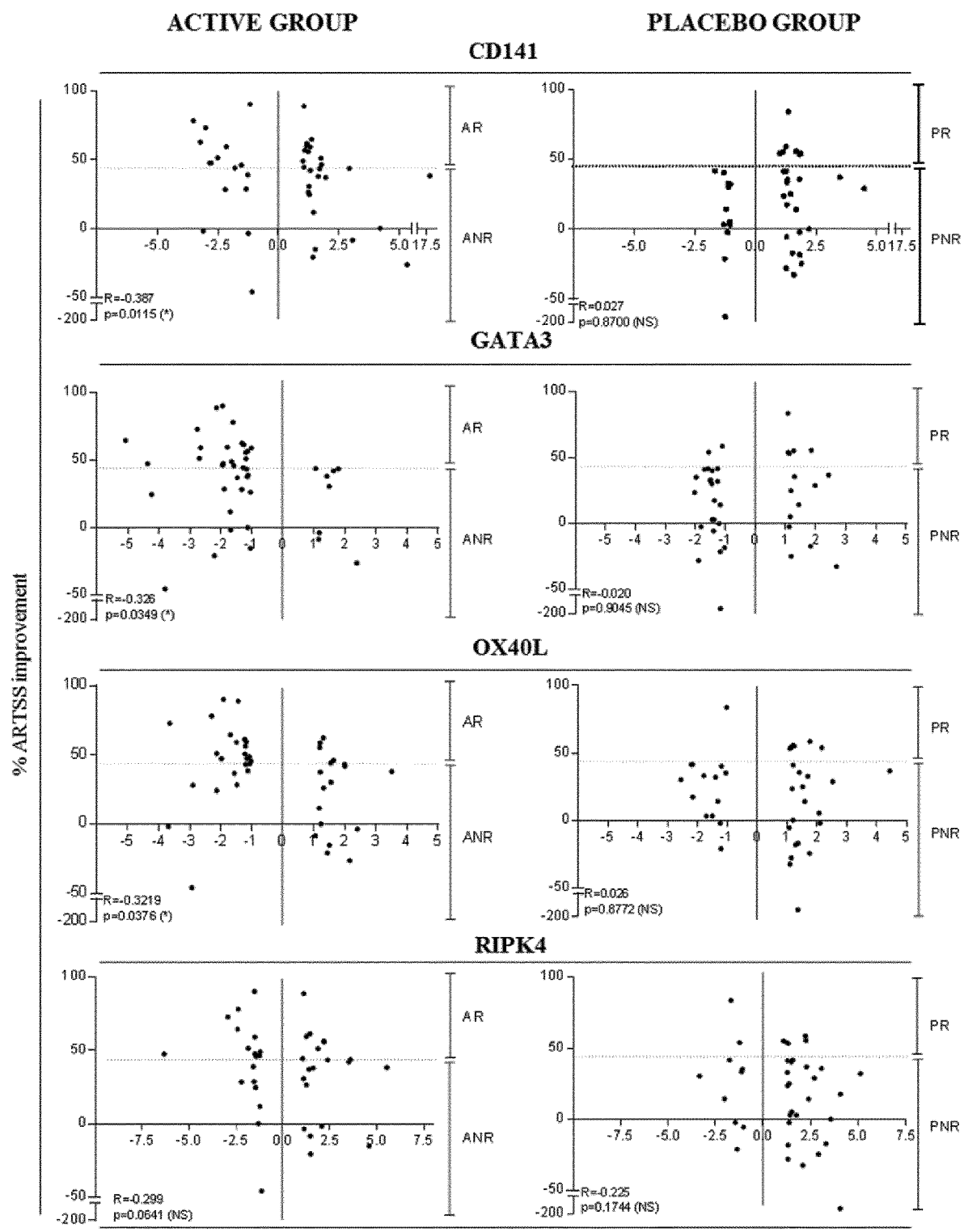
Figure 13:
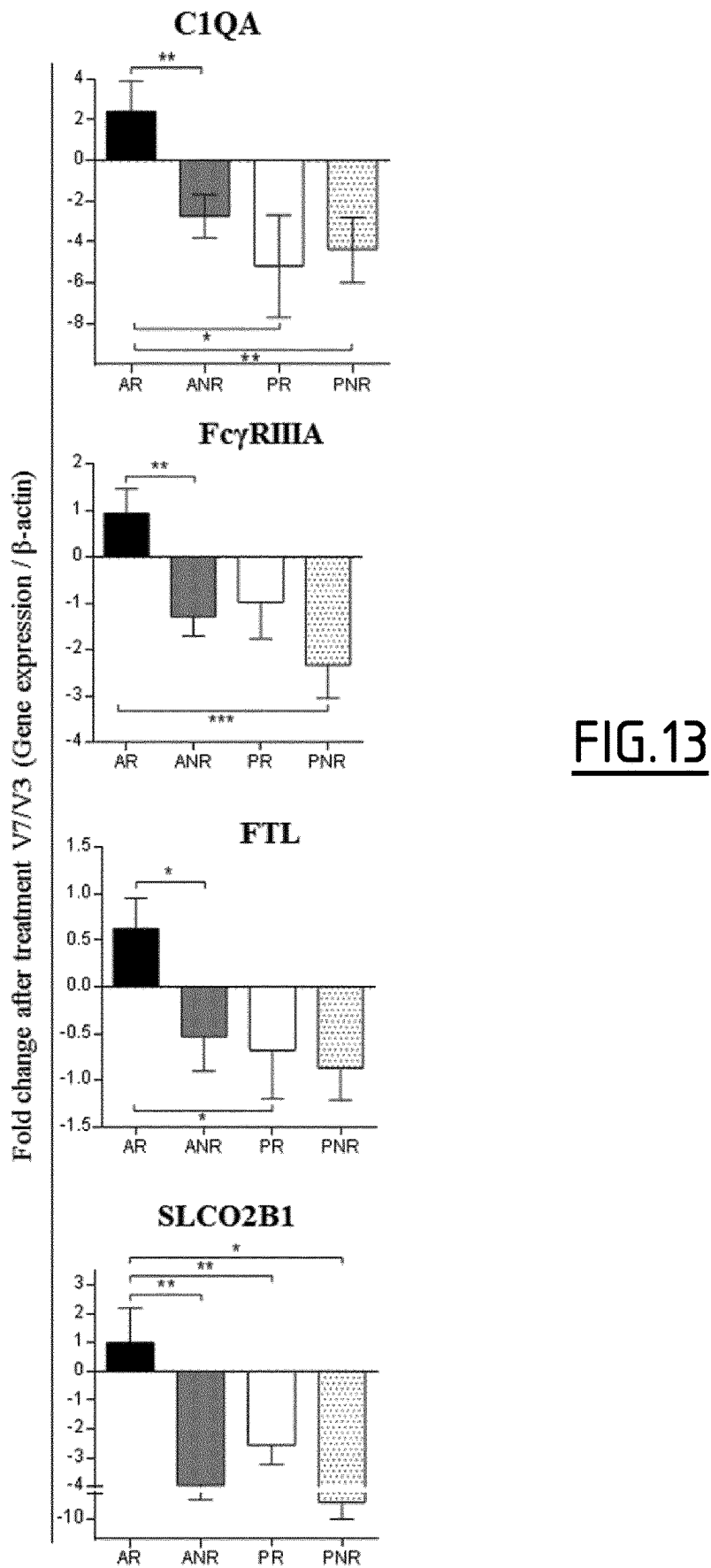
FIG. 13 shows the induction of C1QA, FcγRIIIA, FTL and SLCO2B1 genes in PBMCs from patients with grass pollen allergy receiving AIT after 4 months of treatment. It shows mRNA expression of C1QA, FcγRIIIA, FTL and SLCO2B1 in PBMCs (AR, n=21; ANR, n=21; PR, n=7; and PNR, n=31 except for C1QA, ANR, n=19; and PNR, n=30). p values≤0.05 (*), 0.01 () and 0.001 (*) (Mann-Whitney test).
Figure 14:
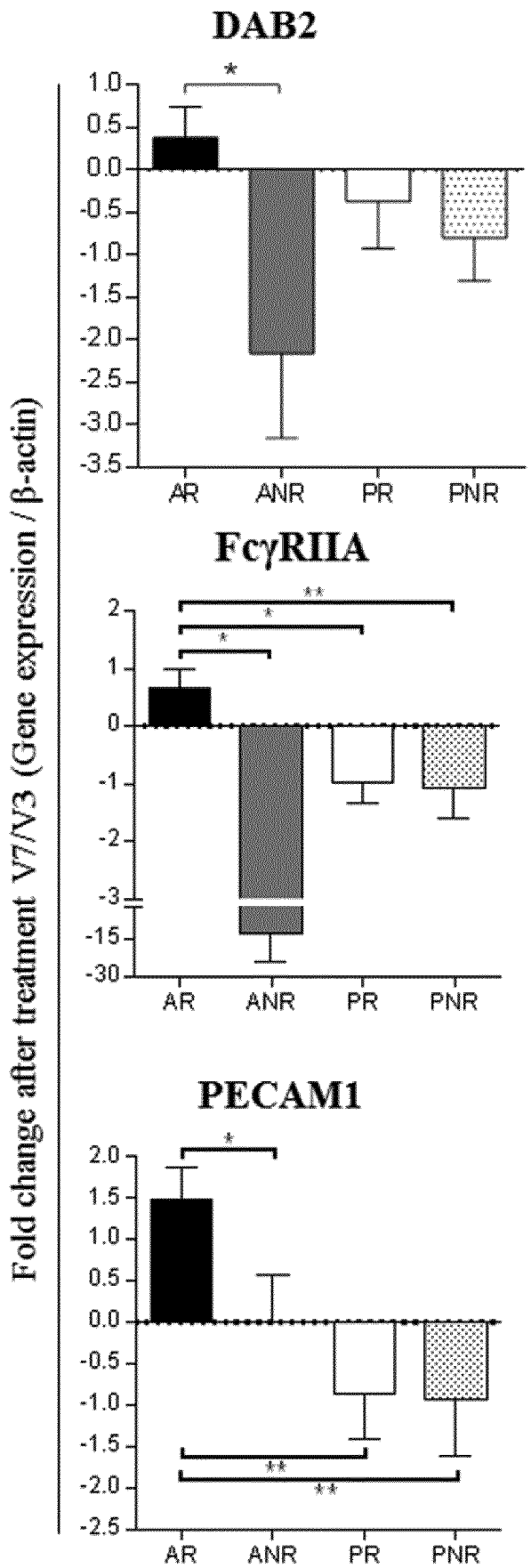
FIG. 14 shows the induction of DAB2, FcγRIIA and PECAM1 genes in PBMCs from patients with grass pollen allergy receiving AIT after 4 months of treatment. It shows mRNA expression of DAB2, FcγRIIA and PECAM1 in PBMCs of patients (AR, n=21; ANR, n=21; PR, n=7; and PNR, n=31). p values of less than 0.05 (*) and 0.01 (**) were considered significant (Mann-Whitney test).

The expression of CD141, GATA3 and RIPK4 was significantly down-regulated in ARs in contrast to ANRs and the placebo group after 4 months of treatment (FIG. 11). Interestingly, when plotted against percentages of ARTSS improvement for each patient, CD141, GATA3, and OX40L but not RIPK4 mRNA expression levels were significantly correlated with clinical benefit in patients from the active group but not from the placebo group after 4 months of treatment (FIG. 12). Finally, no alteration of those markers could be seen after 2 months of treatment.

Figure 15:
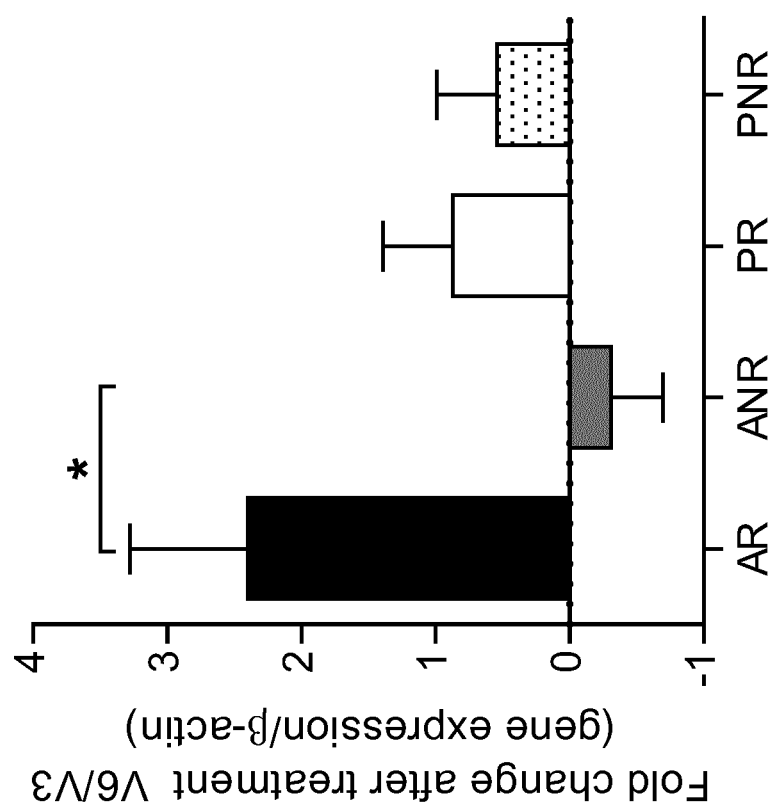
FIG. 15 shows the induction of FcγRIIIA in PBMCs from patients with grass pollen allergy receiving AIT after 2 months of treatment. It shows mRNA expression of FcγRIIIA in PBMCs (AR, n=21; ANR, n=21; PR, n=7; and PNR, n=29). p value≤0.05 (*) (Mann-Whitney test).
Figure 16:
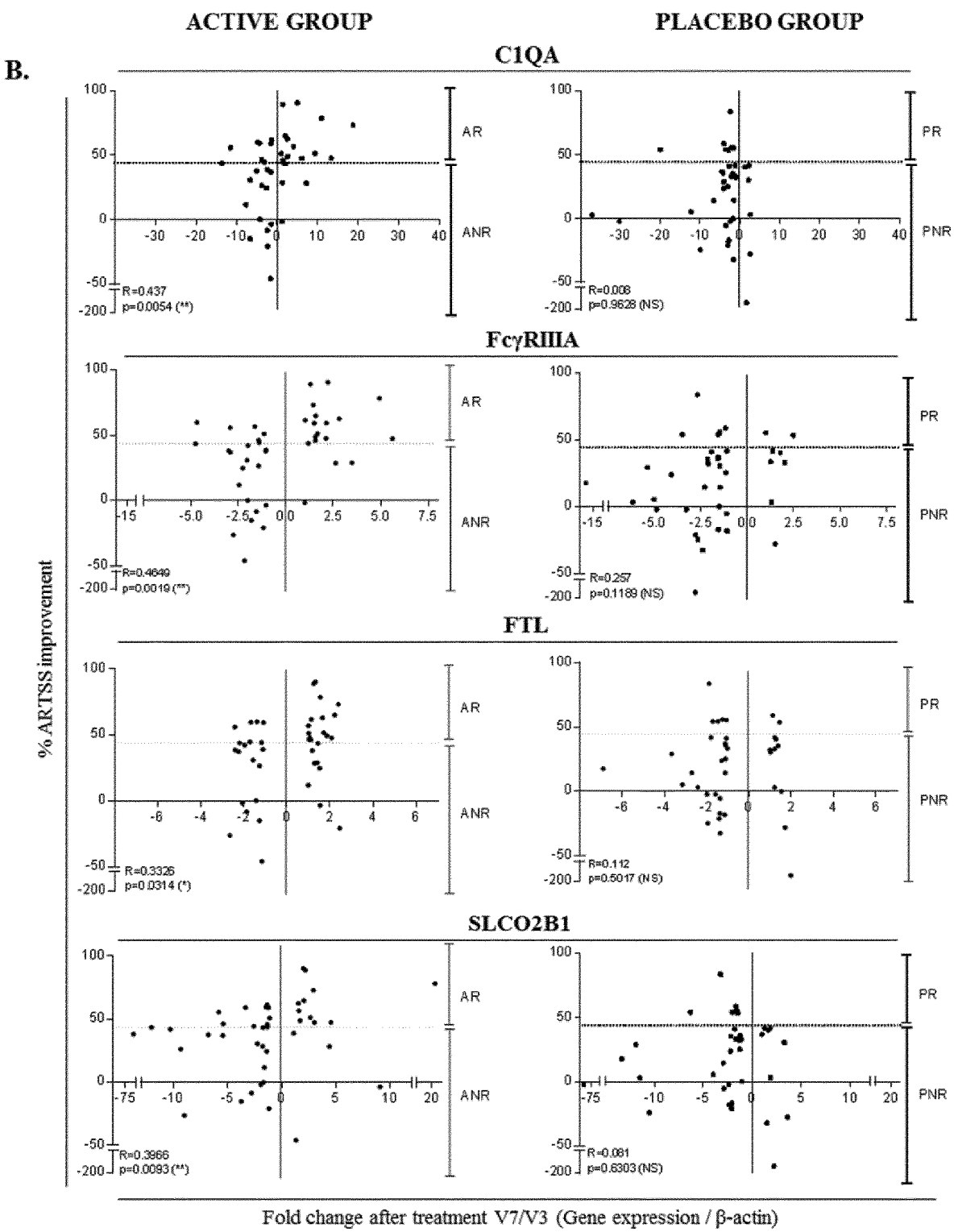
FIG. 16 shows Spearman correlation of mRNA expression of C1QA, FcγRIIIA, FTL and SLCO2B1 with percentages of ARTSS improvement in patients from the active and placebo groups after 4 months of AIT.
Figure 17:
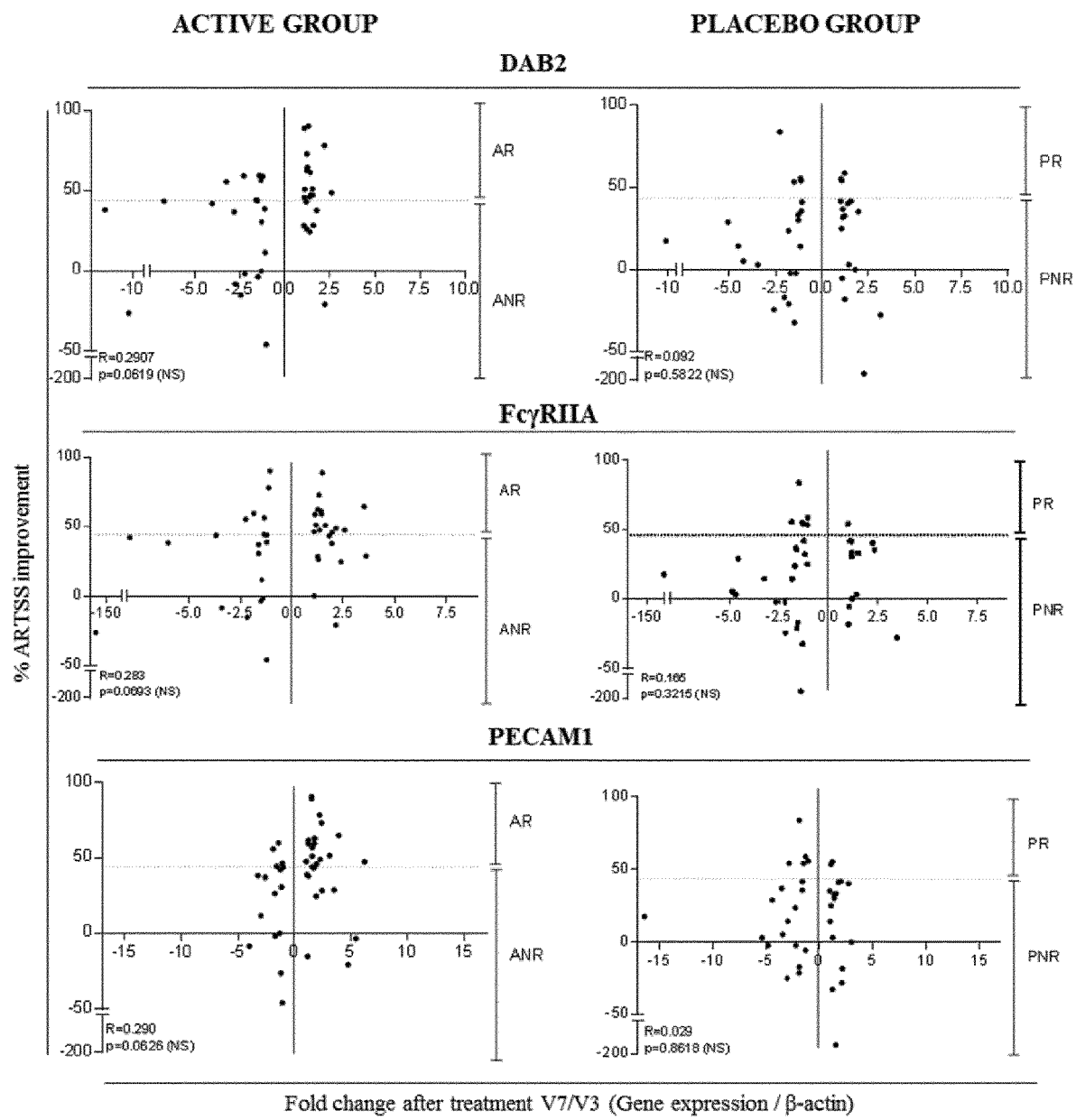
FIG. 17 shows Spearman correlation of mRNA expression of DAB2, FcγRIIA and PECAM1 in PBMCs with percentages of ARTSS improvement in patients from the active and placebo groups after 4 months of AIT.
Figure 18:
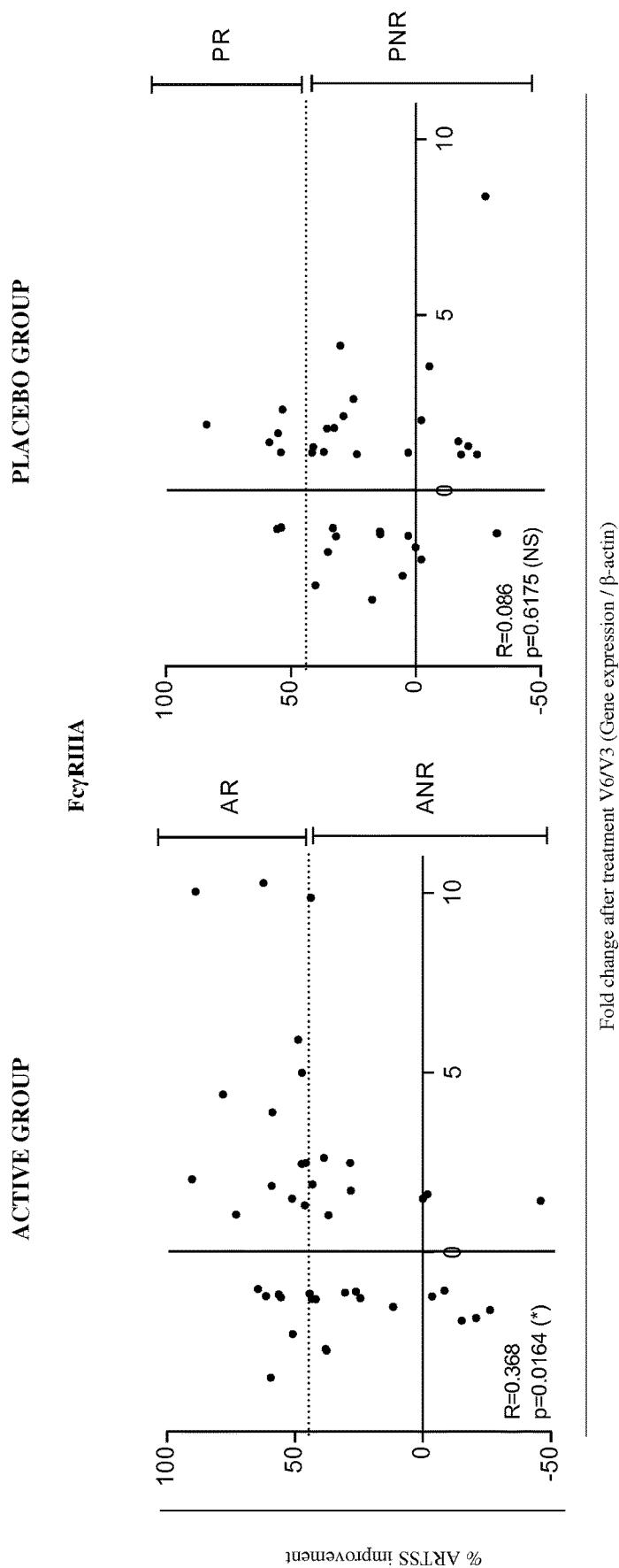
FIG. 18 shows Spearman correlation of mRNA expression of FcγRIIIA with percentages of ARTSS improvement in patients from the active and placebo groups after 2 months of AIT.

In contrast to the down-regulation of DC2 markers, the expression of DCreg markers (i.e. C1QA, DAB2, FcγRIIA, FcγRIIIA, FTL, PECAM1 and SLCO2B1) was significantly up-regulated in ARs in contrast to ANRs and the placebo group, in whom a down-regulation was observed after 4 months of treatment (Figured 13 and 14). Importantly, as early as 2 months of treatment, FcγRIIIA genes were up-regulated in ARs in contrast to ANRs (FIG. 15). Most interestingly, when plotted against percentages of ARTSS improvement of each patient, C1QA, FcγRIIIA, FTL and SLCO2B1 mRNA expression levels were significantly correlated with clinical benefit in patient from the active group but not in the placebo group after 4 months of treatment (FIGS. 16 and 17). An increased expression level of FcγRIIIA also correlated with clinical efficacy in the active group but not in the placebo group after 2 months of therapy (FIG. 18). These results confirm and extend the previous observation of the inventors of an induction of DCreg markers in blood of ARs.

Figure 19:
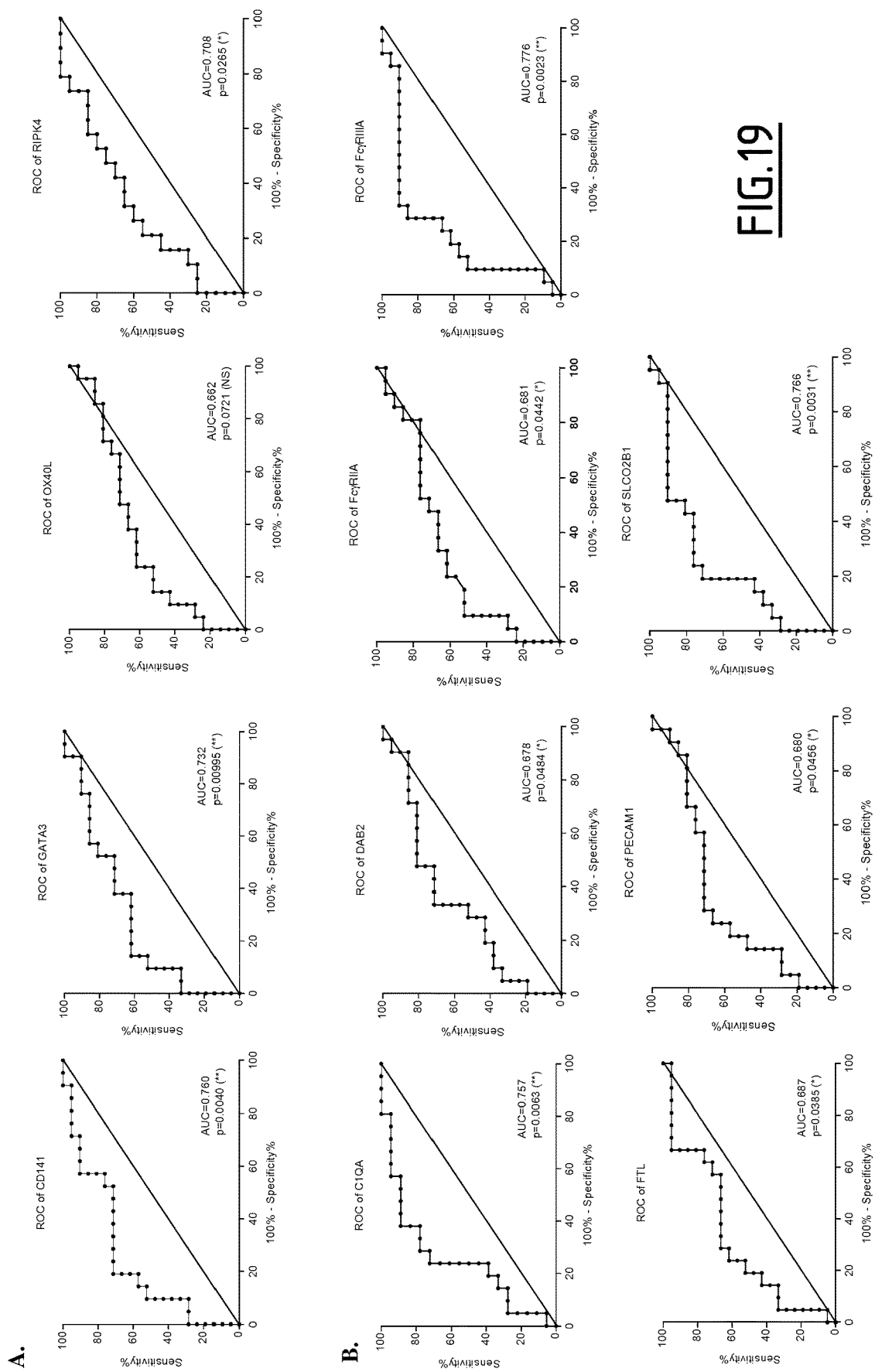
FIG. 19 shows ROC analyses of DC2 (A) and DCreg (B) markers after 4 months of AIT (n=42). AUC=area under the ROC curve. p values of less than 0.05 (*) and 0.01 (**) were considered significant.
Figure 20:
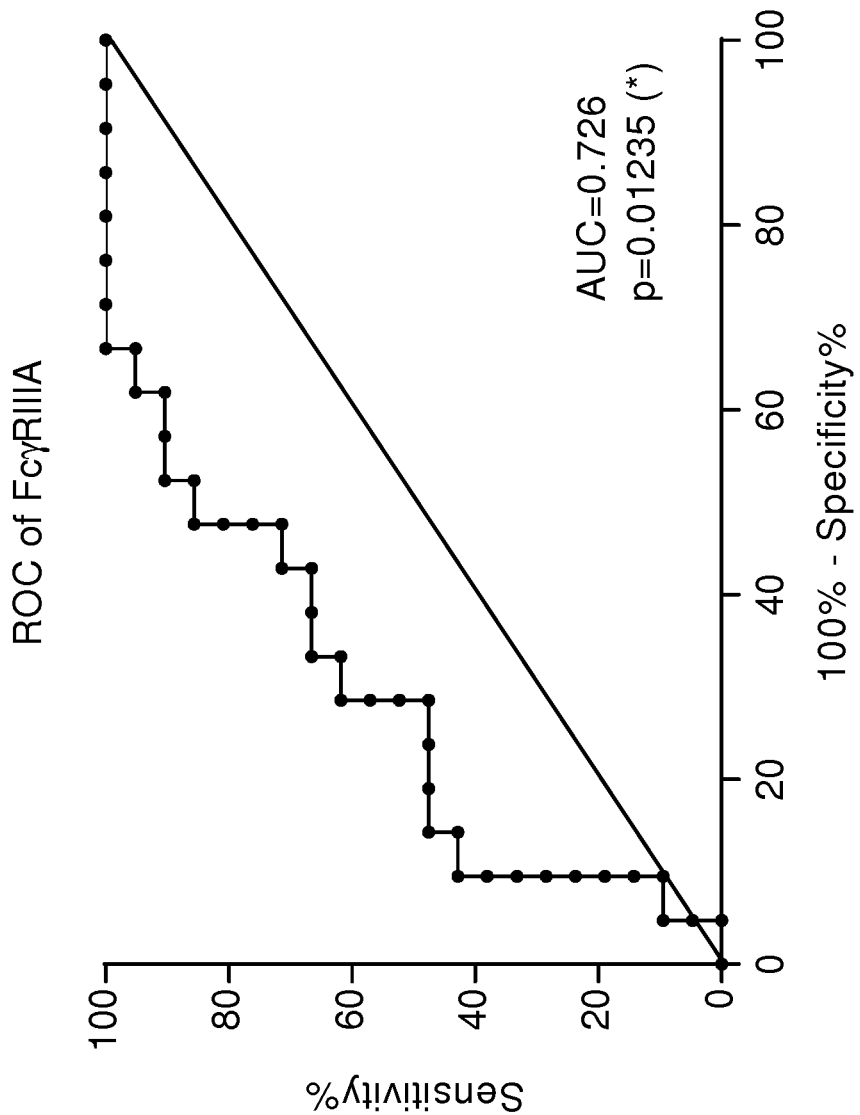
FIG. 20 shows ROC analysis of FcγRIIIA after 2 months of AIT (n=42). AUC=area under the ROC curve. p values of less than 0.05 (*) and 0.01 (**) were considered significant.

The pertinence of these potential biomarkers of efficacy was further assessed by using a ROC analysis. All DC2 and DCreg markers except OX40L (i.e. C1QA, CD141, DAB2, FcγRIIA, FcγRIIIA, FTL, GATA3, PECAM1, RIPK4 and SLCO2B1) are useful to discriminate clinical responders from nonresponders after 4 months of treatment (FIG. 19). After 2 months of treatment, FcγRIIIA is particularly useful to discriminate clinical responders from nonresponders (FIG. 20).

Figure 21:
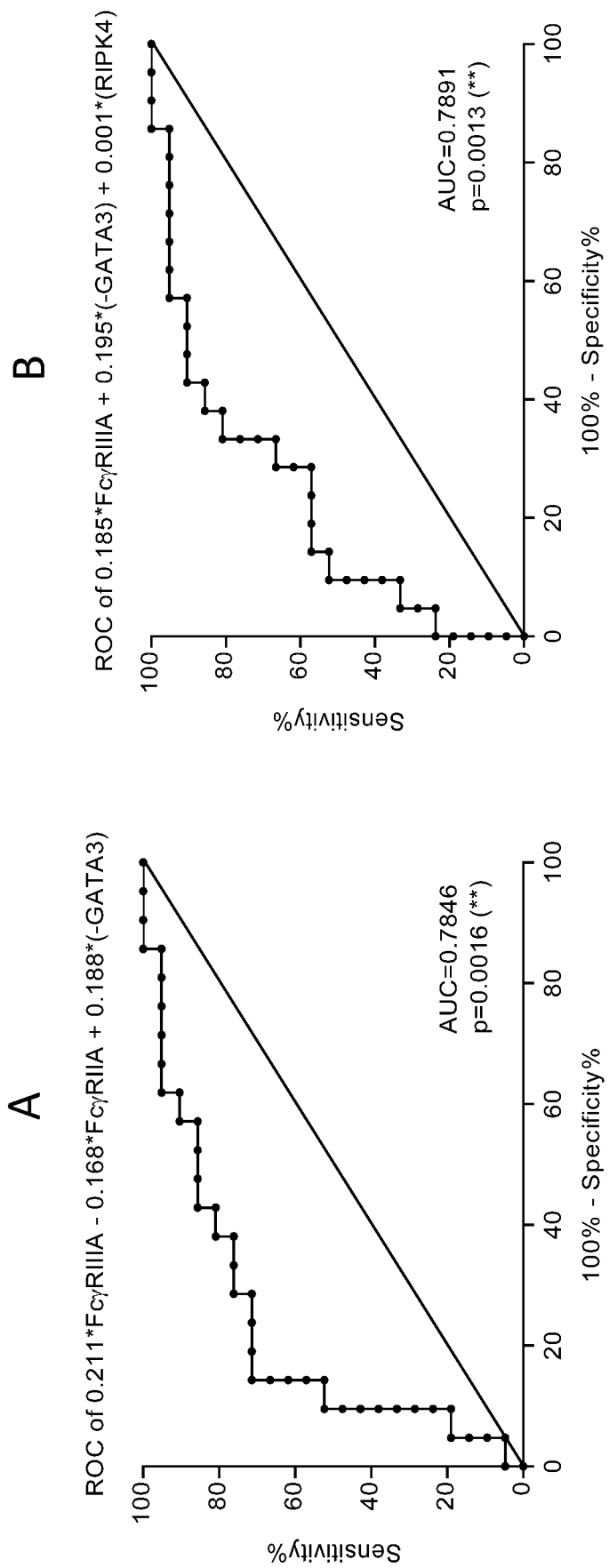
FIG. 21 shows ROC analyses of combination of FcγRIIIA, FcγRIIIA and GATA3 markers after 2 months (A) and after 4 months (B) of AIT (n=42). AUC=area under the ROC curve. p values≤0.01 (**).
Figure 22:
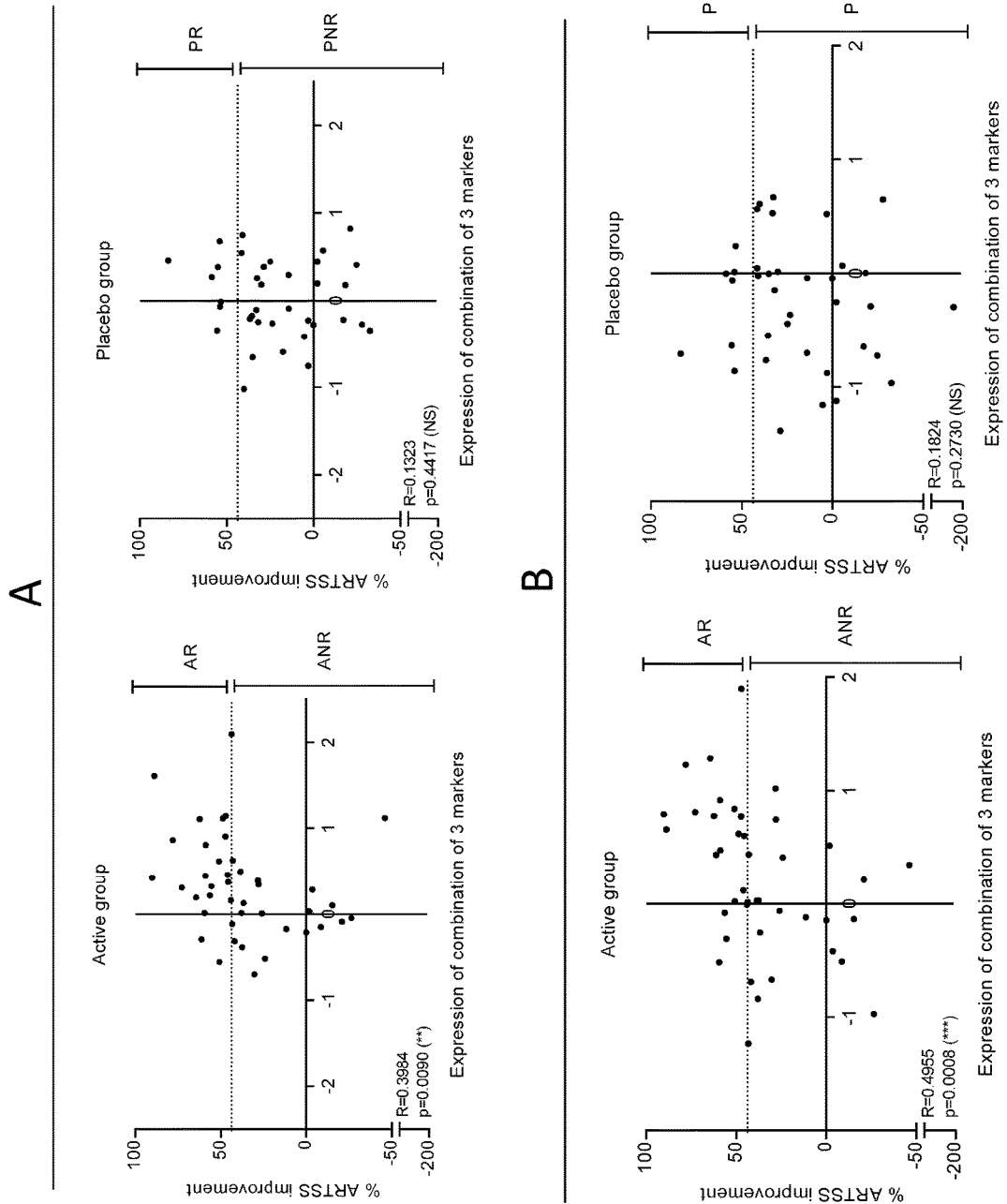
FIG. 22 shows Spearman correlation of expression of 3 combined markers (FcγRIIIA, FcγRIIIA and GATA3) with percentages of ARTSS improvement in patients from the active and placebo groups after 2 months (A) and 4 months (B) of AIT (active, n=42 and placebo, n=36 and 38 after 2 and 4 months of AIT, respectively). p values≤0.01 () and 0.001 (*).
Figure 23:
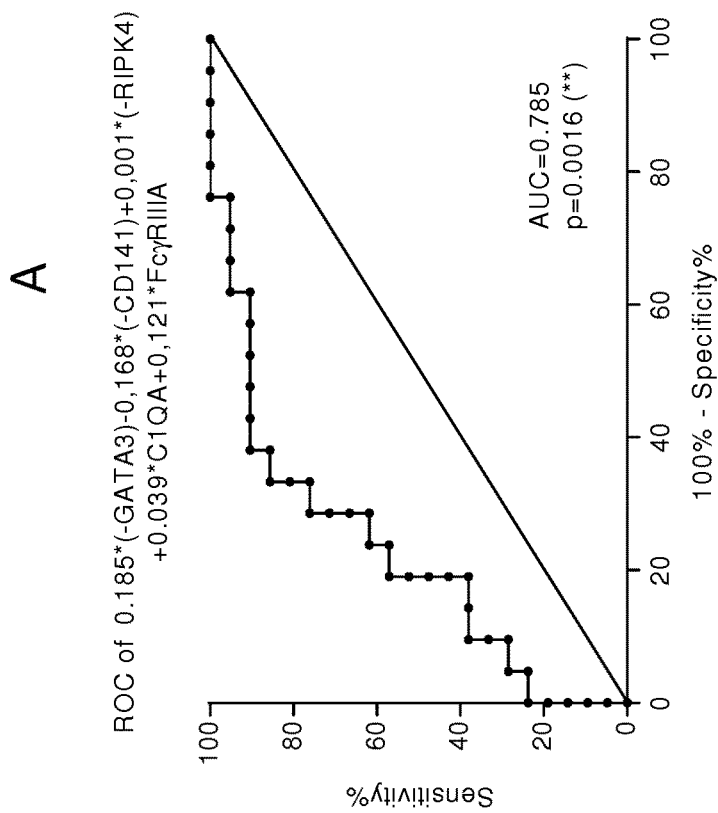
FIG. 23 shows ROC analyses of combination of 2 DCreg (C1QA and FcγRIIIA) and 3 DC2 (GATA3, CD141 and RIPK4) markers after 2 months (A) and after 4 months (B) of AIT (n=42). AUC=area under the ROC curve. p values≤0.01 () and 0.001 (*).
Figure 24:
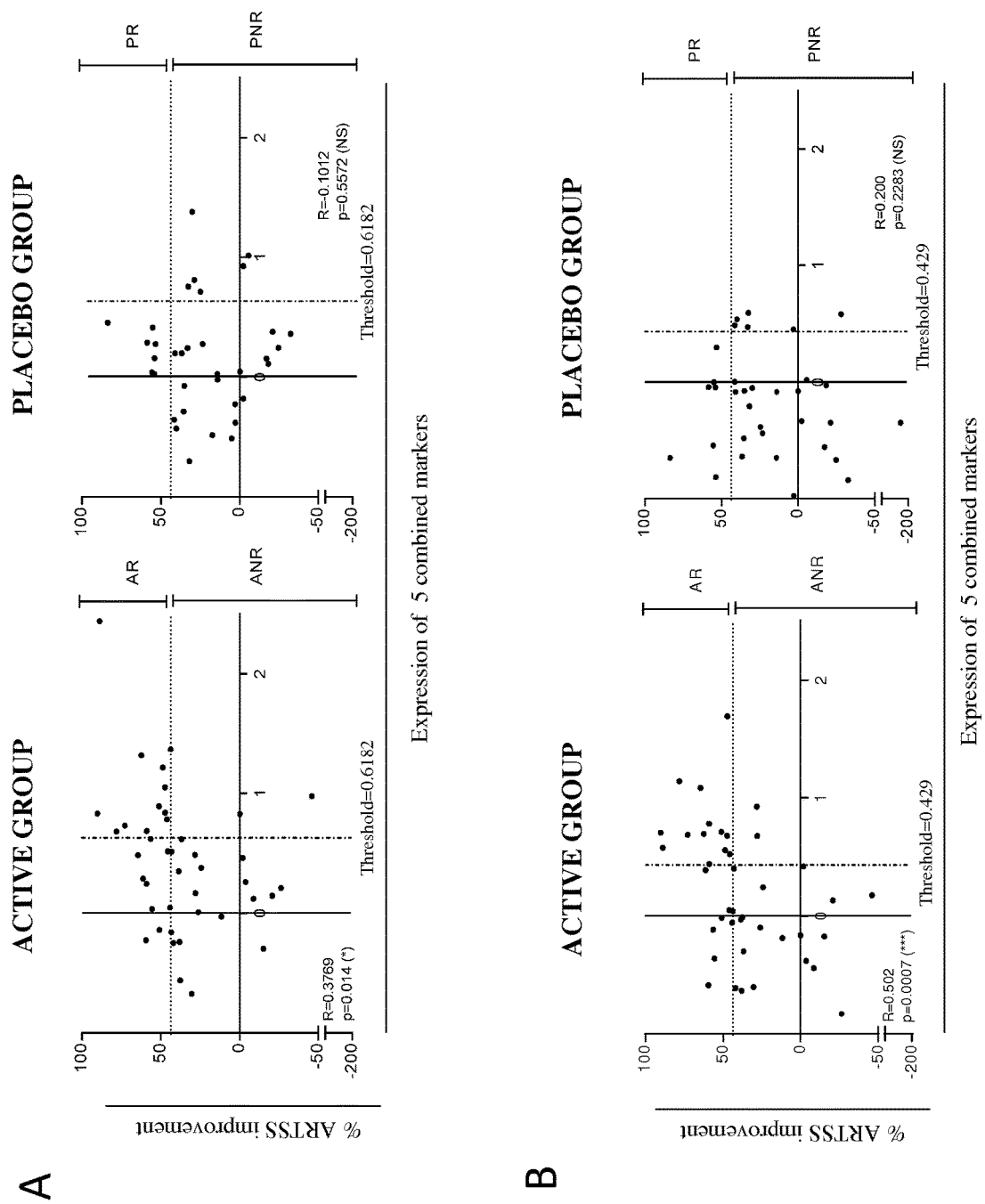
FIG. 24 shows Spearman correlation of expression of 5 combined markers (GATA3, CD141, RIPK4, C1QA and FcγRIIIA) with percentages of ARTSS improvement in patients from the active and placebo groups after 2 months (A) and 4 months (B) of AIT (active, n=42 and placebo, n=36 and 38 after 2 and 4 months of AIT, respectively). p values≤0.01 (*) and 0.001 (**).
Figure 25:
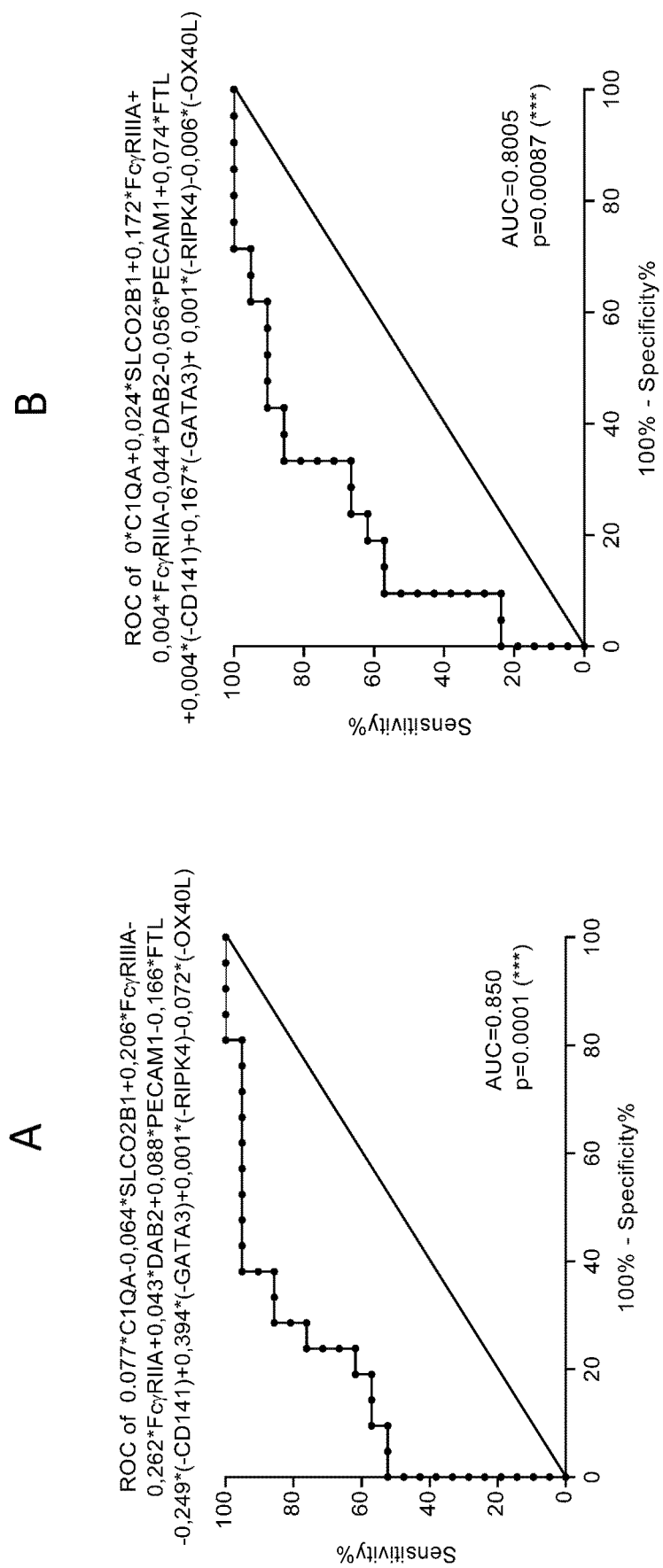
FIG. 25 shows ROC analyses of combination of 7 DCreg (C1QA, SLCO2B1, FcγRIIIA, FcγRIIA, DAB2, PECAM1 and FTL) and 4 DC2 (CD141, GATA3, OX40L and RIPK4) markers after 2 months (A) and after 4 months (B) of AIT (n=42). AUC=area under the ROC curve. p values≤0.001 (***).
Figure 26:
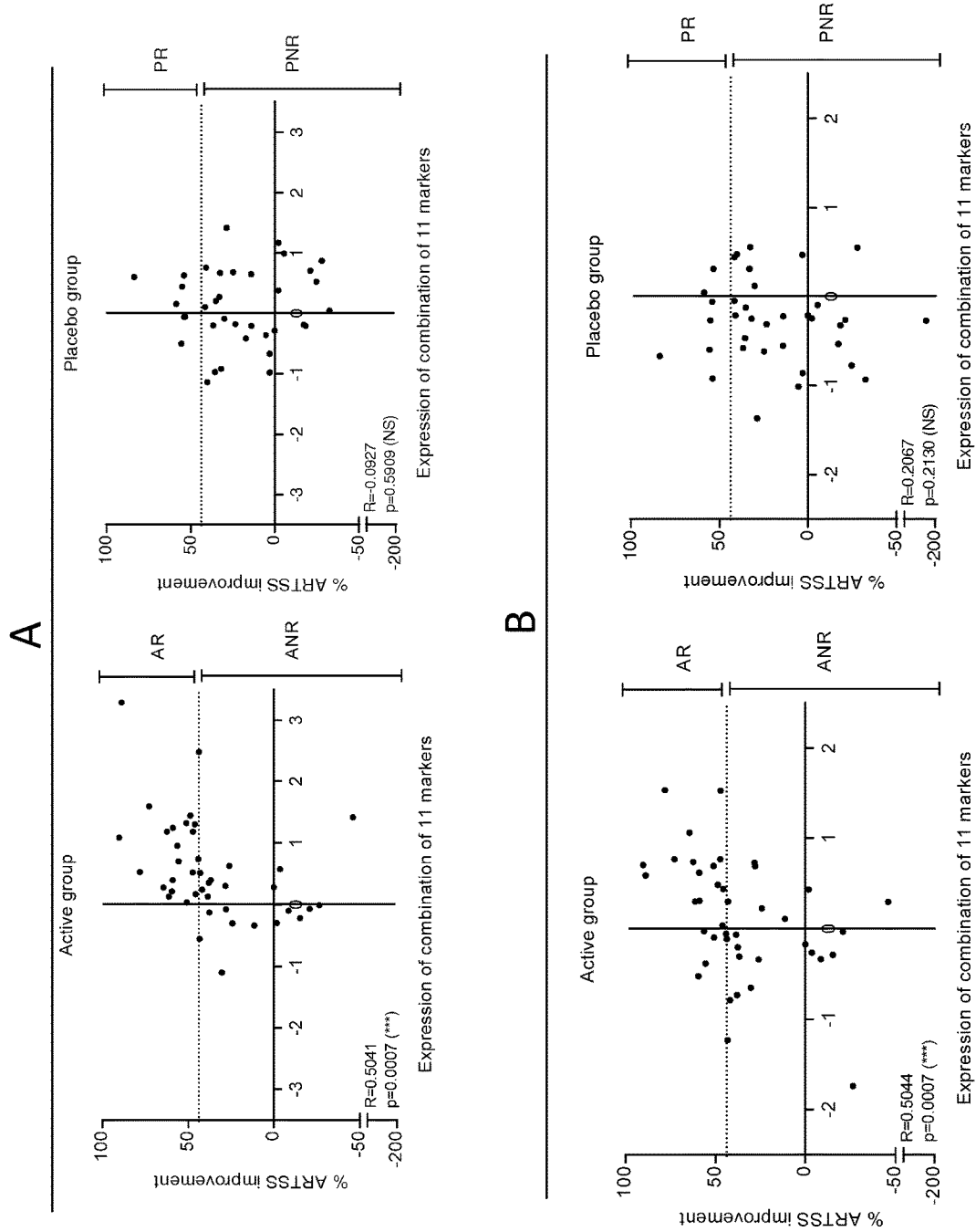
FIG. 26 shows Spearman correlation of expression of 11 combined markers (C1QA, SLCO2B1, FcγRIIIA, FcγRIIA, DAB2, PECAM1, FTL, CD141, GATA3, OX40L and RIPK4) with percentages of ARTSS improvement in patients from the active and placebo groups after 2 months (A) and 4 months (B) of AIT (active, n=42 and placebo, n=36 and 38 after 2 and 4 months of AIT, respectively). p values≤0.001 (***).

As expression of DC2 and DCreg markers were correlated, the inventors next performed ROC analysis with mROC program in order to identify the best combination of markers to discriminate clinical responders from nonresponders after 2 and 4 months of treatment (FIG. 23). By combining 5 markers (i.e. GATA3, CD141, RIPK4, C1QA and FcγRIIIA), they reached an area under the ROC curve (AUC) of 0.785, a threshold of 0.6182 for a sensitivity of 90.48% and a sensibility of 61.9% after 2 months and an AUC of 0.798, a threshold of 0.429 for a sensitivity of 90.48% and a sensibility of 61.9% after 4 months of treatment. Interestingly, when plotted against percentages of ARTSS improvement of each patients, expression of 5 combined markers were correlated with clinical benefit in patients from the active group, with Spearman correlations of 0.38 (p=0.014) and 0.5 (p=0.0007) after 2 and 4 months of AIT, respectively, whereas no such correlation was observed in placebo-treated patients (FIG. 24). For the combination of 3 markers obtained with the mROC program (FIG. 21), when plotted against percentages of ARTSS improvement of each patients, expression of 3 combined markers (FcγRIIA, FcγRIIIA and GATA3) were correlated with clinical benefit in patients from the active group, with Spearman correlations of 0.4 (p=0.009) and 0.5 (p=0.0008) respectively after 2 and 4 months of AIT, whereas no such correlation was observed in placebo-treated patients (FIG. 22). For the combination of 11 DC2 and DCreg markers obtained with the mROC program (FIG. 25), when plotted against percentages of ARTSS improvement of each patients, expression of 11 combined markers were correlated with clinical benefit in patients from the active group, with Spearman correlations of 0.5 (p=0.0007) after 2 and 4 months of AIT, whereas no such correlation was observed in placebo-treated patients (FIG. 26).

TABLE 4

| | | Identification data | | | | | | Quantification data | | | | | |
|---|---|---|---|---|---|---|---|---|---|---|---|---|---|
| | GeneName | Description | SeqRef | ProbeID | Refseq | GeneID | Adj. p value | Fold Change (DC vs Ctrl-DCs) | Average median cent. log2 intensites | | | | |
| | | | | | | | | | Ctrl-DCs | DC1 | DC2 | DCreg |
| A Sequences up-regulated in DC2 | CALCA | Homo sapiens calcitonin-related polypeptide alpha | 886284 | A_23_P301846 | NM_001033952 | 796 | 1.0E-07 | 183.1 | -0.992 | -0.208 | 5.902 | -0.324 |
| | CREM | Homo sapiens cAMP responsive element modulator | 2325230 878925 | A_33_P3318771 A_23_P201979 | NM_001033952 NM_183013 | 796 1390 | 9.7E-07 2.5E-07 | 54.7 8.9 | -0.126 -0.939 | 0.064 0.011 | 5.334 2.348 | -0.688 -0.101 |
| | FMOD | Homo sapiens fibromodulin | 1159270 | A_23_P114883 | NM_002023 | 2331 | 6.5E-06 | 9.7 | -0.037 | 0.138 | 3.088 | -0.101 |
| | GATA3 | Homo sapiens GATA binding protein 3 | 2333191 | A_33_P3360341 | NM_001002295 | 2625 | 1.5E-07 | 46.1 | -0.451 | 0.670 | 4.603 | -0.342 |
| | HCRTR1 | Homo sapiens hypocretin (orexin) receptor 1 | 2330257 886081 | A_33_P3360249 A_23_P74178 | NM_001525 NM_001525 | 3061 3061 | 6.8E-08 8.0E-08 | 23.3 5.0 | 0.190 -0.183 | 0.746 -0.277 | 4.972 2.550 | -0.045 -0.565 |
| | ILDR2 | Homo sapiens immunoglobulin-like domain containing receptor 2 | 2322752 | A_33_P3328317 | NM_199351 | 387597 | 1.4E-07 | 12.3 | -0.686 | 0.273 | 3.094 | -0.101 |
| | ITK | Homo sapiens IL2-inducible T-cell kinase | 1141457 | A_23_P354151 | NM_005546 | 3702 | 2.0E-08 | 30.3 | -1.179 | 1.110 | 3.575 | -0.906 |
| | PADI2 | Homo sapiens peptidyl arginine deiminase, type II | 1154169 1149648 | A_23_P201747 A_24_P187970 | NM_007365 NM_007365 | 11240 11240 | 2.9E-05 8.3E-06 | 9.0 7.2 | 0.437 0.406 | -1.817 -0.897 | 3.786 3.768 | -1.283 -0.794 |
| | PDE4D | Homo sapiens phosphodiesterase 4D, cAMP-specific | 2334429 2320887 | A_33_P3389658 A_33_P3389653 | NM_001165899 NM_001165899 | 5144 5144 | 1.7E-05 1.7E-06 | 8.0 5.4 | -0.094 -0.040 | -0.863 -1.330 | 2.861 2.931 | 0.055 -0.501 |
| | PNOC | Homo sapiens prepronociceptin | 882803 | A_23_P253321 | NM_006228 | 5368 | 1.9E-06 | 44.2 | -0.327 | 0.348 | 5.489 | -0.355 |
| | RGS9 | Homo sapiens regulator of G-protein signaling 9 | 884073 2544564 | A_23_P66881 A_21_P0000057 | NM_003835 NM_001165933 | 8787 ND | 5.3E-09 5.5E-08 | 47.7 22.7 | -0.269 -0.126 | 0.747 0.322 | 5.394 4.393 | -0.938 0.345 |
| | RIPK4 | Homo sapiens receptor-interacting serine-threonine kinase 4 | 887044 | A_24_P125871 | NM_020639 | 54101 | 2.4E-07 | 17.0 | -0.005 | 0.392 | 4.383 | -0.026 |
| | ROR1 | Homo sapiens receptor tyrosine kinase-like orphan receptor 1 | 879927 | A_23_P12363 | NM_005012 | 4919 | 7.9E-07 | 17.0 | -0.599 | 0.356 | 3.639 | -0.003 |
| | SIX2 | Homo sapiens SIX homeobox 2 | 1164459 | A_23_P28120 | NM_016932 | 10736 | 7.0E-07 | 11.4 | 0.057 | 0.331 | 3.564 | 0.027 |
| | SYT4 | Homo sapiens synaptotagmin IV | 1161235 | A_23_P208030 | NM_020783 | 6860 | 2.5E-08 | 63.5 | -0.007 | 0.725 | 5.939 | 0.287 |
| | THBS1 | Homo sapiens thrombospondin 1 | 1155717 | A_24_P142118 | NM_003246 | 7057 | 7.7E-05 | 7.4 | -0.558 | 0.226 | 2.546 | 0.476 |
| | TRIM9 | Homo sapiens tripartite motif containing 9 | 2336091 | A_33_P3383836 | NM_015163 | 114088 | 1.3E-05 | 11.6 | 0.027 | 0.272 | 3.319 | 0.082 |

| | | Identification data | | | | | | Quantification data | | | | | |
|---|---|---|---|---|---|---|---|---|---|---|---|---|---|
| | GeneName | Description | SeqRef | ProbeID | Refseq | GeneID | Adj. p value | Fold Change (DC2 vs Ctrl-DCs) | Average median cent. log2 intensites | | | | |
| | | | | | | | | | Ctrl-DCs | DC1 | DC2 | DCreg |
| B Sequences down-regulated in DC2 | C1QB | Homo sapiens complement component 1, q subcomponent, B chain | 880218 | A_23_P137366 | NM_000491 | 713 | 7.1E-09 | -11.0 | 0.382 | -0.672 | -2.989 | 1.773 |
| | FCER1G | Homo sapiens Fc fragment of IgE, high affinity I, receptor for; gamma polypeptide | 878836 | A_23_P160849 | NM_004106 | 2207 | 1.1E-07 | -11.9 | 0.581 | -0.942 | -2.766 | 0.383 |
| | FCGR3A | Homo sapiens Fc fragment of IgG, low affinity IIIa, receptor (CD16a) | 1146263 | A_23_P200728 | NM_000569 | 2214 | 4.9E-07 | -48.0 | 0.723 | -0.568 | -4.898 | 1.886 |
| | MCTP1 | Homo sapiens multiple C2 domains, transmembrane 1 | 1142060 | A_23_P133293 | NM_024717 | 79772 | 2.6E-07 | -10.4 | 0.236 | -0.401 | -2.989 | 1.033 |

TABLE 4-continued

| | GeneName | Description | Identification data | | | | | Quantification data | | | | | |
|---|---|---|---|---|---|---|---|---|---|---|---|---|---|
| | | | SeqRef | ProbeID | Refseq | GeneID | Adj. p value | Fold Change (DCreg vs Ctrl-DCs.) | Average median cent. log2 intensities | | | | |
| | | | | | | | | | Ctrl-DCs | DC1 | DC2 | DCreg | |
| | SIGLEC5 | *Homo sapiens* sialic acid binding Ig-like lectin 5 | 1157834 | A_24_P48539 | NM_003830 | 8778 | 1.5E-04 | −5.7 | 0.491 | 0.162 | −2.029 | 0.518 |
| C Sequences up-regulated in DCreg | C3AR1 | *Homo sapiens* complement component 3a receptor 1 | 1159311 | A_23_P2431 | NM_004054 | 719 | 5.0E-08 | 4.26 | 0.903 | −0.357 | −0.731 | 3.171 |
| | CD163 | *Homo sapiens* CD163 molecule | 879889 | A_23_P33723 | NM_004244 | 9332 | 3.3E-07 | 38.94 | 0.709 | 0.703 | −1.000 | 5.792 |
| | CD300LF | *Homo sapiens* CD300 molecule-like family member f | 879105 | A_23_P55020 | NM_139018 | 146722 | 9.6E-07 | 9.96 | −0.473 | −1.749 | 0.306 | 2.348 |
| | CFH | *Homo sapiens* complement factor H | 879599 | A_23_P114740 | NM_000186 | 3075 | 1.1E-09 | 11.34 | 1.036 | −0.660 | −0.941 | 4.404 |
| | | | 2332614 | A_33_P3367692 | NM_001014975 | 3075 | 3.3E-06 | 8.29 | 0.187 | −0.603 | −1.012 | 3.252 |
| | | | 2324094 | A_33_P3318288 | NM_001014975 | 3075 | 2.0E-09 | 7.85 | 0.584 | −0.478 | −0.388 | 3.549 |
| | CSGALNACT1 | *Homo sapiens* chondroitin sulfate N-acetylgalactosaminyltransferase 1 | 2319487 | A_33_P3366540 | NM_001130518 | 55790 | 8.4E-07 | 33.15 | 0.486 | −0.844 | 0.082 | 5.311 |
| | | | 882076 | A_23_P134835 | NM_018371 | 55790 | 5.0E-07 | 28.11 | 0.284 | −0.091 | −0.145 | 4.651 |
| | FCGR2A | *Homo sapiens* Fc fragment of IgG, low affinity IIa, receptor (CD32) | 882891 | A_23_P85716 | NM_021642 | 2212 | 1.5E-07 | 6.91 | 1.534 | −1.531 | −2.564 | 4.575 |
| | | | 2332515 | A_33_P3403576 | NM_001136219 | 2212 | 3.1E-07 | 4.66 | 1.237 | −1.951 | −3.754 | 3.848 |
| | FCGR2B | *Homo sapiens* Fc fragment of IgG, low affinity IIb, receptor (CD32) | 1149952 | A_23_P34644 | NM_004001 | 2213 | 6.9E-08 | 5.97 | 1.843 | −2.755 | −3.435 | 4.828 |
| | P2RY14 | *Homo sapiens* purinergic receptor P2Y, G-protein coupled, 14 | 879468 | A_24_P165864 | NM_014879 | 9934 | 1.3E-08 | 4.93 | 0.986 | −1.835 | −2.116 | 3.373 |
| | ZBTB16 | *Homo sapiens* zinc finger and BTB domain containing 16 | 882589 | A_23_P104804 | NM_006006 | 7704 | 8.1E-09 | 71.42 | −0.148 | −0.071 | 0.698 | 5.928 |

TABLE 5

| Accession no. | Protein name | Mascot protein score | No. of peptide identified | Peptide number | m/z measured | Measured mass | z | Δ m/z (ppm) | Retention time (min) | Mascot peptide score | Sequences |
|---|---|---|---|---|---|---|---|---|---|---|---|
| | Proteins up-regulated in DC2 A |
| ADAM8_HUMAN | Disintegrin and metalloproteinase domain-containing protein 8 | 239 | 4 | 40620 | 779.9357 | 3115.7138 | 4 | -1.41 | 107.9 | 76.6 | QVIKPTAFAPPVPPVKPGAGAANPGPAEGAVGPK |
| | | | | 42728 | 992.1332 | 2973.3777 | 3 | -2.40 | 147.0 | 77.1 | QICIVDVCHALTTEDGTAYEPVPEGTR |
| | | | | 45025 | 786.7696 | 2357.2871 | 3 | -1.06 | 136.2 | 49.8 | RPPPAPPVTVSSPPPVPVYTR |
| | | | | 60598 | 576.3161 | 1725.9264 | 3 | -0.58 | 62.1 | 35.8 | TAAVFRPRPGDSLPSR |
| CYTIP_HUMAN | Cytohesin-interacting protein | 231 | 3 | 20264 | 421.7580 | 841.5014 | 2 | -0.93 | 84.0 | 38.2 | QVVDLIR |
| | | | | 31402 | 714.8965 | 1427.7785 | 2 | -1.49 | 132.0 | 80.0 | IQMLADTVATLPR |
| | | | | 46190 | 1121.5353 | 3361.5842 | 3 | -1.28 | 155.0 | 112.6 | IQEDSPAHCAGLQAGDVLANINGVSTEGFTYK |
| | | | | 34452 | 960.7867 | 2879.3384 | 3 | 0.44 | 144.3 | 123.3 | YYLVHQEPLENFQCNVPLGMESGR |
| | | | | 36353 | 544.7830 | 1087.5515 | 2 | 0.52 | 91.4 | 58.0 | SGEIAIDDIR |
| | | | | 46029 | 861.4069 | 2581.1987 | 3 | -6.57 | 88.1 | 59.5 | IANEQISASSTYSDGRWTPQQSR |
| | | | | 48576 | 376.9007 | 1127.6803 | 3 | -1.11 | 91.1 | 63.6 | LISPPVHLPR |
| | | | | 50339 | 849.8991 | 1697.7836 | 2 | -1.17 | 65.8 | 111.9 | IANEQISASSTYSDGR |
| | | | | 52576 | 384.4701 | 1533.8513 | 4 | -0.95 | 68.4 | 40.1 | IRPQTWHSGIALR |
| SEM7A_HUMAN | Semaphorin 7A SEMA7A | 394 | 14 | 33058 | 819.4081 | 2455.2026 | 3 | -1.11 | 118.4 | 76.1 | IRGESELYTSDTVMQNPQFIK |
| | | | | 36596 | 690.8437 | 2759.3455 | 4 | -1.27 | 153.9 | 108.9 | VVEPGEQEHSFAFNIMEIQPPRR |
| | | | | 55401 | 920.7887 | 2759.3442 | 3 | -1.75 | 153.9 | 33.1 | VVEPGEQEHSFAFNIMEIQPPRR |
| | | | | 39122 | 404.7208 | 807.4271 | 2 | -1.00 | 93.9 | 31.3 | WNTFLK |
| | | | | 40165 | 622.0668 | 2484.2381 | 4 | -2.00 | 58.1 | 55.7 | SVLQSINPAEPHKECPNKPDK |
| | | | | 52897 | 497.8549 | 2484.2382 | 5 | -1.96 | 58.1 | 42.7 | SVLQSINPAEPHKECPNKPDK |
| | | | | 58352 | 829.0870 | 2484.2392 | 3 | -1.56 | 58.1 | 59.0 | SVLQSINPAEPHKECPNKPDK |
| | | | | 473861 | 622.0665 | 2484.2369 | 4 | -2.51 | 60.2 | 73.5 | SVLQSINPAEPHKECPNKPDK |
| | | | | 1847 | 382.2284 | 762.4422 | 2 | -0.82 | 107.4 | 36.6 | IFAVMK |
| | | | | 42173 | 688.8444 | 1375.6742 | 2 | -1.64 | 90.7 | 48.8 | AAAIQTMSLDAER |
| | | | | 44705 | 715.7487 | 3573.7073 | 5 | -1.86 | 111.4 | 54.8 | GVHGQDRVDFGQTEPHTVLFHEPGSSSVWVGGR |
| | | | | 58580 | 894.4348 | 3573.7101 | 4 | -1.07 | 111.4 | 102.3 | GVHGQDRVDFGQTEPHTVLFHEPGSSSVWVGGR |
| | | | | 50587 | 713.3365 | 1424.6585 | 2 | -1.49 | 147.5 | 47.9 | DCENYITLLER |
| | | | | 53852 | 702.6727 | 2104.9962 | 3 | -1.81 | 100.1 | 112.1 | MQASHGETFHVLYLTTDR |
| TBC_HUMAN | TBC1 domain family member 13 TBCD1 | 1844 | 6 | 25032 | 622.3736 | 1243.732718 | 2 | -0.71 | 152.0 | 57.4 | ILLNYLPLER |
| | | | | 29111 | 550.3117 | 1098.6088 | 2 | -1.71 | 91.3 | 40.8 | EMIQPGIAK |
| | | | | 31762 | 488.7764 | 975.5382 | 2 | -0.76 | 116.4 | 47.7 | ASWTSILAK |
| | | | | 34023 | 441.9101 | 1322.7084 | 3 | -0.86 | 98.2 | 62.0 | QRELYAQPLR |

TABLE 5-continued

| | | | | | | | | | | | |
|---|---|---|---|---|---|---|---|---|---|---|---|
| C1QC_HUMAN | 463 | Complement C1q subcomponent C | 7 | 47981 | 434.2705 | 866.5264 | 2 | -0.26 | 115.6 | 46.0 | ILFIYAK |
| | | | | 49432 | 693.8124 | 1385.6102 | 2 | -2.24 | 70.5 | 81.4 | SLDDSQCGITYK |

Proteins down-regulated in CD2 B

| | | | | | | | | | | | |
|---|---|---|---|---|---|---|---|---|---|---|---|
| C1QA_HUMAN | 359 | Complement C1q subcomponent A | 5 | 7211 | 542.7927 | 1083.5708 | 2 | -0.47 | 103.3 | 64.7 | FQSVFTVTR |
| | | | | 10303 | 486.9314 | 1457.7725 | 3 | -0.95 | 56.2 | 85.3 | QTHQPPAPNSLLIR |
| | | | | 41140 | 729.8931 | 1457.7717 | 2 | -1.52 | 56.2 | 41.2 | QTHQPPAPNSLLIR |
| | | | | 18280 | 629.3483 | 1256.6820 | 2 | -1.36 | 69.0 | 70.1 | TNQVNSGGVLLR |
| | | | | 23817 | 964.4533 | 1926.8921 | 2 | -2.02 | 100.4 | 102.6 | FNAVLTNPQGDYDTSTGK |
| | | | | 64298 | 822.0504 | 2463.1294 | 3 | -3.37 | 105.1 | 99.1 | FNAVLTNPQGDYDTSTGKFTCK |
| | | | | 66075 | 822.0510 | 2463.1313 | 3 | -2.61 | 105.3 | 84.2 | FNAVLTNPQGDYDTSTGKFTCK |

Proteins up-regulared in DCreg C

| | | | | | | | | | | | |
|---|---|---|---|---|---|---|---|---|---|---|---|
| C1QA_HUMAN | 359 | Complement C1q subcomponent A | 5 | 23302 | 419.8944 | 1256.6613 | 3 | -1.00 | 69.1 | 47.4 | GQPRPAFSAIR |
| | | | | 23608 | 614.3273 | 1226.6401 | 2 | -0.58 | 84.2 | 43.9 | VGYPGPSGPLGAR |
| | | | | 32984 | 819.7395 | 2456.1966 | 3 | -1.89 | 165.5 | 126.4 | KGHIYQGSEADSVFSGFLIFPSA |
| | | | | 59227 | 478.5100 | 1910.0111 | 4 | -0.60 | 67.9 | 62.4 | GSPGNIKDQPRPAFSAIR |
| | | | | 69800 | 637.6774 | 1910.0104 | 3 | -0.96 | 67.9 | 79.0 | GSPGNIKDQPRPAFSAIR |
| C1QB_HUMAN | 381 | Complement C1q subcomponent B | 5 | 16830 | 538.7700 | 1075.5255 | 2 | -1.10 | 93.0 | 46.5 | GNLCVNLMR |
| | | | | 16880 | 554.2749 | 1659.8028 | 3 | -1.03 | 118.8 | 91.5 | VPGLYYFTYHASSR |
| | | | | 47661 | 830.9081 | 1659.8017 | 2 | -1.72 | 118.7 | 90.4 | VPGLYYFTYHASSR |
| | | | | 25983 | 826.3894 | 2476.1463 | 3 | -3.65 | 116.1 | 94.9 | DQTIRPDHVITNMNNNYEPR |
| | | | | 38532 | 621.9520 | 1862.8341 | 3 | -1.55 | 84.3 | 57.3 | FDHVITNMNNNYEPR |
| C1QC_HUMAN | 463 | Complement C1q subcomponent C | 7 | 7211 | 542.7927 | 1083.5708 | 2 | -0.47 | 103.3 | 64.7 | FQSVFTVTR |
| | | | | 10303 | 486.9314 | 1457.7725 | 3 | -0.95 | 56.2 | 85.3 | QTHQPPAPNSLLIR |
| | | | | 41140 | 729.8931 | 1457.7717 | 2 | -1.52 | 56.2 | 41.2 | QTHQPPAPNSLLIR |
| | | | | 18280 | 629.3483 | 1256.6820 | 2 | -1.36 | 69.0 | 70.1 | TNQVNSGGVLLR |
| | | | | 23817 | 964.4533 | 1926.8921 | 2 | -2.02 | 100.4 | 102.6 | FNAVLTNPQGDYDTSTGK |
| | | | | 64298 | 822.0504 | 2463.1294 | 3 | -3.37 | 105.1 | 99.1 | FNAVLTNPQGDYDTSTGKFTCK |
| | | | | 66075 | 822.0510 | 2463.1313 | 3 | -2.61 | 105.3 | 84.2 | FNAVLTNPQGDYDTSTGKFTCK |
| CP1B1_HUMAN | 225 | Cytochrome p450 1B1 | 3 | 51421 | 549.2843 | 1096.5540 | 2 | -1.22 | 124.4 | 44.3 | NFSNFILDK |
| | | | | 60809 | 1223.6314 | 2445.2482 | 2 | -1.33 | 180.1 | 131.6 | TVGAGSLVDVMPWLQYFPNPVR |
| | | | | 68218 | 816.0895 | 2445.2466 | 3 | -2.00 | 180.1 | 49.2 | TVGAGSLVDVMPWLQYFPNPVR |
| DAP2_HUMAN | 255 | Disabled homolog 2 | 6 | 6529 | 619.8475 | 1237.6804 | 2 | 7.85 | 130.1 | 19.2 | DLFQVTYNVK |
| | | | | 27331 | 619.8420 | 1237.6695 | 2 | -1.01 | 162.8 | 49.9 | DLFQVTYNVK |
| | | | | 26826 | 672.6523 | 2014.9349 | 3 | -0.52 | 122.6 | 67.1 | AFGYVCGGEGQHQFFAIK |
| | | | | 33990 | 699.3838 | 1396.7530 | 2 | -2.32 | 102.6 | 61.4 | TGQQAEPLVVDLK |
| | | | | 34785 | 592.3176 | 1182.6207 | 2 | -3.24 | 111.2 | 22.7 | LIGIDDVPDAR |
| | | | | 48106 | 708.8256 | 1415.6366 | 2 | 0.62 | 141.1 | 53.7 | STDNAFENPFFK |
| DPYD_HUMAN | 355 | Dihydropyrimidine dehyrogenase | 7 | 41225 | 490.7739 | 979.5332 | 2 | -0.63 | 92.0 | 50.5 | SFITSLANK |
| | | | | 48858 | 711.8782 | 1421.7419 | 2 | -1.20 | 124.7 | 57.8 | SLSVNEMTLSTLK |
| | | | | 50757 | 630.3615 | 1888.0628 | 3 | -0.81 | 82.9 | 35.0 | RTTYGVSGTAIRPIALR |
| | | | | 53711 | 934.8158 | 2801.4255 | 3 | -0.74 | 167.4 | 55.7 | DAIFQGLTQDFGYTSKDFLPLVA |

TABLE 5-continued

| | | [NADP(+)] | | | | | | | | | K |
|---|---|---|---|---|---|---|---|---|---|---|---|
| FCG2A_HUMAN | Low affinity immunoglobulin gamma Fc region receptor II-a | 221 | | 58226 | 752.3550 | 2254.0430 | 3 | -3.18 | 104.0 | 66.6 | SIEELQDWDGQSPATVSHQK |
| | | | | 65601 | 519.5747 | 1555.7023 | 3 | -2.24 | 75.5 | 41.8 | AGMCACHSPLPSIR |
| | | | | 71371 | 451.7703 | 901.5261 | 2 | -1.30 | 132.4 | 47.4 | DFLPLIVAK |
| FCG2B_HUMAN | Low affinity immunoglobulin gamma Fc region receptor II-b | | 2 | 46172 | 896.4039 | 2686.1899 | 3 | -1.11 | 99.7 | 149.1 | RQLEETNNDYETADGGYMTLNPR |
| | | | | 55013 | 971.1279 | 2910.3618 | 3 | -2.30 | 127.9 | 71.6 | SPESDSIQWFHNGNLIPTHTQPSYR |
| FRIL_HUMAN | Ferritin light chain FTL | 470 | 5 | 33831 | 1014.4865 | 3040.4376 | 3 | -2.35 | 158.3 | 158.8 | VGAENTITYSLLMHPDALEEPDDQNRI |
| | | | | 33860 | 904.8170 | 2711.4292 | 3 | -0.87 | 164.7 | 114.9 | AVLKLEPQWINVLQEDSVTLTCR |
| | | | | 34178 | 761.6872 | 2282.0397 | 3 | 1.11 | 72.2 | 58.2 | EMGETLPEKPANPTNPDEADK |
| | | | | 39411 | 802.3802 | 3205.4916 | 4 | -1.55 | 113.3 | 73.6 | GTHSPESDSIQWFHNGNLIPTHTQPSRY |
| | | | | 41999 | 642.1060 | 3205.7937 | 5 | -0.90 | 113.4 | 64.2 | GTHSPESDSIQWFHNGNLIPTHTQPSRY |
| | | 768 | 9 | 2304 | 574.0000 | 1718.9780 | 3 | -0.62 | 105.9 | 118.1 | KLNQALLDLHALGSAR |
| | | | | 6034 | 430.7515 | 1718.9771 | 4 | -1.18 | 105.9 | 77.3 | KLNQALLDLHALGSAR |
| | | | | 23593 | 860.4946 | 1718.9746 | 2 | -2.61 | 105.9 | 114.6 | KLNQALLDLHALGSAR |
| | | | | 3378 | 782.3621 | 2344.0644 | 3 | -1.61 | 155.2 | 104.2 | TDPHLCDFLETHFLDEEVK |
| | | | | 4359 | 587.0329 | 2344.0667 | 4 | -0.66 | 155.2 | 98.7 | TDPHLCDFLETHFLDEEVK |
| | | | | 27245 | 1173.0397 | 2344.0648 | 2 | -1.44 | 155.2 | 85.2 | TDPHLCDFLETHFLDEEVK |
| | | | | 3846 | 417.7393 | 833.4640 | 2 | -0.84 | 86.5 | 39.7 | ALFQDIK |
| | | | | 21979 | 536.6067 | 1606.7984 | 3 | -0.43 | 154.4 | 41.0 | LGGPEAGLGEYLFER |
| | | | | 25842 | 531.3019 | 1590.8837 | 3 | -0.30 | 121.7 | 89.5 | LNQALLDLHALGSAR |
| GSHI_HUMAN | Glutamate-cysteine ligase catalytic subunit GCLC | 317 | 5 | 34579 | 514.8283 | 1027.6420 | 2 | -0.94 | 137.8 | 40.0 | VVINVPIFK |
| | | | | 42132 | 726.0763 | 2900.2762 | 4 | -0.76 | 116.6 | 74.5 | IHLDDANESDHFENIQSTNWQTMR |
| LRC28_HUMAN | Leucine-rich repeat-containing protein 25 LRRC25 | 151 | 3 | 46362 | 424.5952 | 1270.7638 | 3 | -0.86 | 114.4 | 44.4 | VVINVPIFKDK |
| | | | | 48893 | 1028.4602 | 2054.9056 | 2 | -0.50 | 138.8 | 95.8 | NTPSPIRTFTEDDEASR |
| | | | | 52159 | 419.7410 | 1674.9349 | 4 | -0.52 | 111.4 | 62.4 | HGILQFLHIYHAVK |
| NS1BP_HUMAN | Influenza virus NS1A-binding protein IVNS1ABP | 98 | 2 | 42808 | 478.3000 | 954.5854 | 2 | -0.86 | 124.6 | 53.8 | LEVLNVLR |
| | | | | 46857 | 477.2659 | 1428.7760 | 3 | -0.37 | 136.5 | 59.3 | ELPVTFFAHLQK |
| | | | | 73402 | 715.3946 | 1428.7747 | 2 | -1.23 | 136.5 | 37.9 | ELPVTFFAHLQK |
| | | | | 50593 | 541.2784 | 1620.8135 | 3 | 5.76 | 65.6 | 39.6 | LIAAGGYNREECLR |
| | | | | 73462 | 363.4312 | 1449.6955 | 4 | -0.94 | 55.8 | 58.2 | LQVCGHEMLAHR |

TABLE 5-continued

| | | | | | | | | | | | |
|---|---|---|---|---|---|---|---|---|---|---|---|
| NUD16_HUMAN | U8 snoRNA-decapping enzyme NUDT16 | 605 | 8 | 27279 | 968.9919 | 1935.9693 | 2 | 0.08 | 172.1 | 100.0 | DGVGGLPTFLENSPIGSAR |
| | | | | 28810 | 604.3433 | 1206.6721 | 2 | -0.03 | 124.1 | 65.8 | DHGLEVLGLVR |
| | | | | 35457 | 403.2310 | 1206.6721 | 3 | -0.82 | 124.0 | 80.2 | DHGLEVLGLVR |
| | | | | 34907 | 771.4260 | 2311.2562 | 3 | -3.16 | 177.8 | 83.9 | EQLLEALQDLGLLQSGSISGLK |
| | | | | 71198 | 1156.6372 | 2311.2598 | 2 | -1.60 | 177.8 | 95.6 | EQLLEALQDLGLLQSGSISGLK |
| | | | | 37429 | 431.2625 | 860.5104 | 2 | -1.88 | 86.1 | 38.0 | VPLYTLR |
| | | | | 48520 | 543.3013 | 1626.8821 | 3 | -1.31 | 144.6 | 81.5 | RLELGEALALGSGWR |
| | | | | 59975 | 581.3303 | 1740.9691 | 3 | -2.50 | 153.4 | 59.6 | RLTLEELLAVEAGATR |
| PDCD4_HUMAN | Programmed cell death protein 4 | 226 | 3 | 31716 | 829.4224 | 2485.2453 | 3 | -1.43 | 156.5 | 100.3 | IYNEIPDINLDVPHSYSVLER |
| | | | | 44656 | 423.2614 | 844.5082 | 2 | -1.19 | 145.2 | 53.3 | MILDLLK |
| | | | | 49664 | 894.9252 | 1787.8359 | 2 | -2.30 | 137.0 | 72.2 | AVGDGILCNTYIDSYK |
| PECA1_HUMAN | Platelet endothelial cell adhesion molecule PECAM1 | 1118 | 15 | 18358 | 664.3299 | 1326.6452 | 2 | -0.33 | 118.5 | 59.1 | STESYFIPEVR |
| | | | | 23955 | 693.1004 | 3460.4655 | 5 | -0.84 | 85.7 | 28.2 | NSNDPAVFKDNPTED VEYQCVADNCHSHAK |
| | | | | 27562 | 446.2497 | 1780.9695 | 4 | -1.56 | 109.5 | 75.2 | APIHFTIEKLELNEK |
| | | | | 28122 | 744.3384 | 1486.6623 | 2 | 0.89 | 82.1 | 59.9 | SDSGTYICTAGIDK |
| | | | | 31674 | 752.0483 | 2253.1231 | 3 | -0.62 | 115.7 | 60.0 | QMPVEMSRPAVPLLNSNNEK |
| | | | | 32518 | 511.2644 | 1530.7714 | 3 | 0.16 | 58.8 | 60.0 | IISGIHMQTSESTK |
| | | | | 73926 | 766.3917 | 1530.7688 | 2 | -1.57 | 58.8 | 86.2 | IISGIHMQTSESTK |
| | | | | 33103 | 833.8435 | 1665.6725 | 2 | -0.22 | 92.0 | 46.3 | EQEGEYYCTAFNR |
| | | | | 42511 | 762.8932 | 1523.7719 | 2 | 0.01 | 118.2 | 69.6 | SELTVTVTESFSTPK |
| | | | | 43635 | 837.7794 | 2510.3164 | 3 | -1.55 | 144.0 | 101.9 | CTIQVTHLAQEFPEIIIQKDK |
| | | | | 43885 | 620.9814 | 1859.9225 | 3 | -0.47 | 163.6 | 80.3 | SNTVQIVVCEMLSQPR |
| | | | | 45957 | 756.7387 | 2267.1942 | 3 | -1.86 | 156.7 | 66.7 | CTIQVTHLAQEFPEIIIQK |
| | | | | 53138 | 352.5339 | 1054.5799 | 3 | -1.16 | 72.4 | 70.1 | APIHTIEK |
| | | | | 54846 | 547.9748 | 2187.8700 | 4 | 0.07 | 47.2 | 64.0 | MSDPNMEANSHYGHNDDVR |
| | | | | 73094 | 730.2970 | 2187.8693 | 3 | -0.25 | 47.1 | 82.4 | MSDPNMEANSHYGHNDDVR |
| RNAS6_HUMAN | Ribonuclease K6 RNASE6 | 145 | 3 | 22242 | 566.0311 | 2260.0953 | 4 | -0.33 | 112.5 | 39.3 | AHWFEIQHIQPSPLQCNR |
| | | | | 26585 | 754.3718 | 2260.0935 | 3 | -1.11 | 112.5 | 78.8 | AHWFEIQHIQPSPLQCNR |
| | | | | 30445 | 661.3328 | 1320.6510 | 2 | -2.04 | 110.2 | 27.0 | FFIVACDPPQK |
| RNT2_HUMAN | Ribonuclease T2 RNASET2 | 112 | 2 | 36103 | 619.2258 | 1854.9856 | 3 | -1.25 | 127.2 | 60.9 | LGIKPSINYQVADFK |
| | | | | 63130 | 757.6804 | 2270.0195 | 3 | -0.89 | 144.5 | 51.5 | DCRDPDYWTHGLWPDK |
| SOXB1_HUMAN | Solute carrier organic anion transporter family member 2B1 SLCO2B1 | 95 | 2 | 32214 | 798.9317 | 1595.8488 | 2 | -1.89 | 98.1 | 64.3 | SSSPAVEQQLLVSGPGK |
| | | | | 57116 | 731.9033 | 1461.7920 | 2 | -1.33 | 70.3 | 30.4 | RIGPAGEVPQVPDK |

TABLE 5-continued

| Accession no. | Identification data | | | Quantification data | | | | | | | |
|---|---|---|---|---|---|---|---|---|---|---|---|
| | SEQ ID NO: | Use in quantitation | Max fold | Highest mean condition | Lowest mean condition | p value <0.01 | FDR | Average normalized abundance | | | |
| | | | | | | | | Crtl-DCs | DC1 | DC2 | DCreg |
| Proteins up-regulated in DC2 A | | | | | | | | | | | |
| ADAM8_HUMAN | 154 | True | 209.6 | DC2 | DCreg | 1.1E-02 | 4.1E-07 | 49287 | 504170 | 1288393 | 6146 |
| | 155 | True | 25.2 | DC2 | DCreg | 4.1E-07 | | 68926 | 378007 | 957710 | 37987 |
| | 156 | True | 89.4 | DC2 | DCreg | 1.1E-03 | | 18609 | 348135 | 791433 | 8851 |
| | 157 | True | 21716.3 | DC2 | DCreg | 7.3E-04 | | 2074 | 20383 | 133531 | 6 |
| CYTIP_HUMAN | 158 | True | 2.5 | DC2 | DCreg | 3.4E-05 | | 168567 | 310569 | 415902 | 164477 |
| | 159 | True | 1.4 | DC2 | DCreg | 3.7E-04 | | 50252 | 384611 | 557797 | 45026 |
| | 160 | True | 21.1 | DC2 | Ctrl-DCs | 3.4E-02 | | 50692 | 511229 | 1071806 | 55618 |
| | 161 | True | 18.7 | DC2 | DCreg | 2.5E-04 | | 151995 | 644771 | 1644140 | 87804 |
| | 162 | True | 13.7 | DC2 | DCreg | 2.5E-06 | | 28560 | 134921 | 295704 | 21643 |
| | 163 | True | 4.4 | DC2 | DCreg | 2.1E-01 | | 57651 | 146593 | 220459 | 49801 |
| | 164 | True | Infinity | DC2 | DCreg | 2.1E-04 | | 594 | 66350 | 261166 | 0 |
| | 165 | True | 75.4 | DC2 | DCreg | 2.1E-01 | | 5414 | 111265 | 355791 | 4717 |
| | 166 | True | 7097.8 | DC2 | DCreg | 2.1E-03 | | 363 | 22052 | 94544 | 13 |
| SEM7A_HUMAN | 167 | True | 60.5 | DC2 | DCreg | 3.2E-02 | | 27816 | 437916 | 1324295 | 21893 |
| | 168 | True | 39.0 | DC2 | DCreg | 3.4E-05 | | 32341 | 336465 | 1221461 | 31352 |
| | 169 | True | 41.5 | DC2 | DCreg | 1.1E-01 | | 15906 | 61277 | 357794 | 8621 |
| | 170 | True | Infinity | DC2 | Ctrl-DCs | 1.0E-03 | | 0 | 62718 | 223729 | 0 |
| | 170 | True | 35.9 | DC2 | DCreg | 2.3E-07 | | 32857 | 239108 | 1001751 | 27892 |
| | 170 | True | 17.8 | DC2 | DCreg | 1.5E-03 | | 18251 | 57079 | 317373 | 17849 |
| | 170 | True | 321.1 | DC2 | Ctrl-DCs | 7.3E-06 | | 1389 | 30315 | 445894 | 1801 |
| | 171 | True | 91.6 | DC1 | DC2 | 3.5E-01 | | 1189 | 90482 | 988 | 2451 |
| | 172 | True | 2473.0 | DC2 | DCreg | 2.2E-04 | | 116 | 39511 | 201874 | 82 |
| | 173 | True | Infinity | DC2 | DCreg | 4.2E-03 | | 2244 | 52580 | 320675 | 0 |
| | 173 | True | 80.4 | DC2 | DCreg | 1.6E-02 | | 22432 | 242583 | 888854 | 11060 |
| | 174 | True | Infinity | DC2 | Ctrl-DCs | 8.2E-11 | | 0 | 61257 | 360296 | 0 |
| | 174 | True | 134924.5 | DC2 | DCreg | 1.1E-03 | | 2546 | 35259 | 265951 | 2 |
| | 175 | True | 38.9 | DC2 | Ctrl-DCs | 1.0E-01 | | 8094 | 46240 | 314775 | 8641 |
| TBC_HUMAN | 176 | True | 8.1 | DC2 | DCreg | 3.8E-04 | | 115793 | 579639 | 774879 | 96091 |
| | 177 | True | 6.9 | DC2 | DCreg | 1.4E-04 | | 69330 | 320850 | 434657 | 63124 |
| | 178 | True | 7.6 | DC2 | DCreg | 3.8E-05 | | 49119 | 198307 | 316907 | 41745 |
| | 179 | True | 11.9 | DC2 | DCreg | 2.0E-04 | | 24157 | 149819 | 246663 | 20796 |
| | 180 | False | 58.3 | DC2 | Ctrl-DCs | 2.1E-02 | | 1648 | 28487 | 96114 | 3050 |
| | 181 | True | 26.0 | DC2 | Ctrl-DCs | 2.2E-01 | | 10346 | 120129 | 269005 | 17175 |
| Proteins down-regulated in DC2 B | | | | | | | | | | | |
| C1QC_HUMAN | 182 | True | 16.5 | DCreg | DC2 | 3.7E-06 | | 1845331 | 505826 | 233719 | 3862088 |
| | 183 | True | 23.0 | DCreg | DC2 | 1.8E-05 | | 1339675 | 356410 | 142830 | 3290331 |
| | 183 | True | 494.5 | DCreg | DC2 | 1.2E-02 | | 174862 | 25371 | 1377 | 681081 |
| | 184 | True | 15.9 | DCreg | DC2 | 1.1E-03 | | 499581 | 292150 | 112707 | 1790150 |

TABLE 5-continued

| | | | | | | | | | | |
|---|---|---|---|---|---|---|---|---|---|---|
| C1QA_HUMAN | 185 | True | 177.4 | DCreg | DC2 | 2.2E-02 | 1283024 | 43313 | 21341 | 3786198 |
| | 186 | True | Infinity | DCreg | DC1 | 5.5E-03 | 18351 | 0 | 0 | 95834 |
| | 186 | True | Infinity | DCreg | DC2 | 2.0E-03 | 5246 | 1770 | 0 | 70445 |
| | | | | Proteins up-regulated in DCreg C | | | | | | |
| C1QB_HUMAN | 187 | False | 14.2 | DCreg | DC1 | 5.4E-05 | 171783 | 54710 | 91384 | 774305 |
| | 188 | True | 7.1 | DCreg | DC2 | 2.2E-05 | 522942 | 480161 | 320306 | 2265965 |
| | 189 | True | 7.5 | DCreg | DC2 | 2.2E-05 | 329553 | 176475 | 173793 | 1297106 |
| | 190 | True | Infinity | DCreg | DC1 | 1.6E-03 | 3645 | 0 | 0 | 150002 |
| | 190 | True | Infinity | DCreg | DC2 | 1.9E-05 | 121 | 20 | 0 | 98083 |
| C1QB_HUMAN | 191 | True | 34.6 | DCreg | DC2 | 3.6E-05 | 351204 | 62158 | 52822 | 1825126 |
| | 192 | True | 53.7 | DCreg | DC2 | 3.9E-06 | 749388 | 145785 | 68423 | 3676086 |
| | 192 | True | 58.6 | DCreg | DC2 | 6.1E-05 | 7306 | 6183 | 5949 | 348671 |
| | 193 | True | 34.2 | DCreg | DC2 | 6.8E-05 | 310207 | 97738 | 61260 | 2095064 |
| | 194 | True | Infinity | DCreg | DC2 | 1.5E-03 | 32761 | 4281 | 0 | 736461 |
| C1QC_HUMAN | 195 | True | 16.5 | DCreg | DC2 | 3.7E-06 | 1845331 | 505826 | 233719 | 3862088 |
| | 196 | True | 23.0 | DCreg | DC2 | 1.8E-05 | 1339675 | 356410 | 142830 | 3290331 |
| | 196 | True | 494.5 | DCreg | DC2 | 1.2E-02 | 174862 | 25371 | 1377 | 681081 |
| | 197 | True | 15.9 | DCreg | DC2 | 1.1E-03 | 499581 | 591150 | 112707 | 1790150 |
| | 198 | True | 177.4 | DCreg | DC2 | 2.2E-02 | 1283024 | 43313 | 21341 | 3786198 |
| | 199 | True | Infinity | DCreg | DC1 | 5.5E-03 | 18351 | 0 | 0 | 95834 |
| | 199 | True | Infinity | DCreg | DC2 | 2.0E-03 | 5246 | 1770 | 0 | 70445 |
| CP1B1_HUMAN | 200 | True | 33.3 | DCreg | DC2 | 6.6E-02 | 95830 | 13418 | 3833 | 127730 |
| | 201 | True | 5.4 | DCreg | DC2 | 3.7E-02 | 211635 | 82257 | 69022 | 369989 |
| | 201 | True | 11.1 | DCreg | DC1 | 7.8E-03 | 51883 | 11702 | 14346 | 129442 |
| DAP2_HUMAN | 202 | False | 1.5 | DCreg | DC2 | 1.2E-03 | 2244487 | 1806006 | 1767824 | 2620959 |
| | 202 | True | 6.3 | DCreg | DC2 | 2.1E-06 | 279674 | 109475 | 65483 | 412357 |
| | 203 | True | 5.6 | DCreg | DC2 | 1.4E-06 | 595052 | 217775 | 157193 | 886757 |
| | 204 | True | 7.5 | DCreg | DC2 | 1.4E-7 | 386035 | 57525 | 80652 | 603722 |
| | 205 | True | 3.3 | DCreg | DC1 | 2.0E-03 | 205587 | 95619 | 100344 | 312129 |
| | 206 | True | 5.2 | DCreg | DC1 | 1.7E-05 | 315416 | 95461 | 102039 | 496963 |
| DPYD_HUMAN | 207 | True | 6.0 | DCreg | DC1 | 9.9E-04 | 156481 | 43946 | 63634 | 264525 |
| | 208 | True | 27.1 | DCreg | DC2 | 2.9E-02 | 122573 | 8123 | 14551 | 219908 |
| | 209 | True | 78.0 | DCreg | DC1 | 7.7E-04 | 112282 | 4776 | 3153 | 245914 |
| | 210 | True | 3.9 | DCreg | DC1 | 8.0E-04 | 118751 | 54385 | 55210 | 212884 |
| | 211 | True | 30.4 | DCreg | DC2 | 3.7E-02 | 51554 | 17811 | 5161 | 157127 |
| | 212 | True | 6.5 | DCreg | DC1 | 1.5E-01 | 30743 | 18729 | 15095 | 97969 |
| | 213 | False | Infinity | DCreg | DC1 | 4.0E-02 | 3564 | 0 | 0 | 16994 |
| FCG2A_HUMAN | 214 | True | 65.1 | DCreg | DC1 | 5.0E-02 | 101527 | 10788 | 32758 | 702145 |
| | 215 | True | 23.6 | DCreg | DC2 | 1.6E-01 | 80325 | 55341 | 23363 | 551485 |
| FCG2B_HUMAN | 216 | True | 72.9 | DCreg | DC1 | 2.0E-02 | 165769 | 16900 | 46272 | 1232793 |
| | 217 | True | 8.8 | DCreg | DC2 | 1.5E-05 | 279671 | 170986 | 129348 | 1140016 |
| | 218 | True | 2.9 | DCreg | DC1 | 1.4E-03 | 333840 | 228200 | 280976 | 654719 |
| | 219 | True | 41.0 | DCreg | DC1 | 5.4E-02 | 190828 | 34112 | 37862 | 1397548 |
| | 219 | True | 21.5 | DCreg | DC1 | 2.1E-03 | 129897 | 39504 | 41686 | 848246 |

TABLE 5-continued

| | | | | | | | | |
|---|---|---|---|---|---|---|---|---|
| FRIL_HUMAN | 220 | True | 2.7 | DCreg | DC1 | 3.1E-04 | 9028936 | 5831391 | 6026760 | 15498177 |
| | 220 | True | 2.4 | DCreg | DC1 | 1.1E-03 | 2441139 | 1712601 | 1776340 | 4171118 |
| | 220 | True | 2.2 | DCreg | DC2 | 3.0E-02 | 824927 | 781491 | 761910 | 1658217 |
| | 221 | True | 2.8 | DCreg | DC2 | 2.4E-04 | 9767972 | 6088824 | 5891114 | 16328683 |
| | 221 | True | 2.7 | DCreg | DC1 | 3.9E-04 | 4955168 | 3136020 | 3208186 | 8559298 |
| | 221 | True | 9.4 | DCreg | DC1 | 1.3E-01 | 794526 | 276221 | 452365 | 2590366 |
| | 222 | True | 3.4 | DCreg | DC1 | 5.9E-02 | 1910875 | 1448455 | 1571448 | 4991774 |
| | 223 | True | 4.0 | DCreg | DC1 | 5.6E-04 | 398613 | 217925 | 306463 | 876779 |
| | 224 | True | 2.5 | DCreg | DC2 | 1.2E-02 | 253922 | 213556 | 193756 | 484566 |
| GSHI_HUMAN | 225 | True | 2.7 | DCreg | NS | 5.9E-03 | 75405 | 93773 | 120372 | 204049 |
| | 226 | True | 2.2 | DCreg | DC1 | 1.8E-02 | 270246 | 185293 | 234151 | 407509 |
| | 227 | True | 2.8 | DCreg | DC1 | 8.0E-03 | 55698 | 35849 | 39616 | 100225 |
| | 228 | True | 2.0 | DCreg | DC2 | 5.2E-02 | 238018 | 213746 | 200026 | 403322 |
| | 229 | True | 2.5 | DCreg | NS | 2.3E-01 | 76407 | 115575 | 108738 | 190188 |
| LRC28_HUMAN | 230 | True | 4.2 | DCreg | DC1 | 2.1E-01 | 54580 | 29767 | 67129 | 127450 |
| | 231 | True | 3.0 | DCreg | DC1 | 2.4E-02 | 68448 | 44454 | 51956 | 134250 |
| | 231 | True | 41.2 | DCreg | DC1 | 2.2E-01 | 2066 | 3363 | 675 | 27809 |
| NS1BP_HUMAN | 232 | True | 5.2 | DCreg | DC2 | 4.1E-03 | 40518 | 58826 | 36228 | 188014 |
| | 233 | True | 21.1 | DCreg | DC2 | 1.9E-02 | 7303 | 3619 | 2002 | 42211 |
| NUD16_HUMAN | 234 | True | 1.9 | DCreg | DC1 | 1.8E-06 | 1197452 | 832148 | 910778 | 1543110 |
| | 235 | True | 2.0 | DCreg | DC1 | 1.1E-03 | 181481 | 172210 | 199122 | 359046 |
| | 235 | True | 3.8 | DCreg | DC1 | 1.0E-04 | 89517 | 45409 | 71981 | 171397 |
| | 236 | True | 2.8 | DCreg | DC1 | 1.2E-03 | 261534 | 163733 | 218868 | 456761 |
| | 236 | True | 12.1 | DCreg | DC2 | 7.4E-02 | 38757 | 18798 | 7808 | 94260 |
| | 237 | True | 4.6 | DCreg | DC2 | 3.1E-02 | 90704 | 85730 | 83012 | 384830 |
| | 238 | True | 4.2 | DCreg | DC1 | 5.8E-03 | 63810 | 30067 | 33916 | 126576 |
| | 239 | True | 2.8 | DCreg | DC2 | 4.5E-01 | 73241 | 40399 | 38050 | 108135 |
| PDCD4_HUMAN | 24 | True | 8.4 | DCreg | DC1 | 2.5E-03 | 677129 | 141522 | 254665 | 1185836 |
| | 241 | True | 34.1 | DCreg | DC1 | 8.4E-03 | 90727 | 4531 | 5409 | 154655 |
| | 242 | True | 27.5 | DCreg | DC2 | 1.4E-02 | 167905 | 19048 | 17041 | 469423 |

TABLE 5-continued

| | | | | | | | |
|---|---|---|---|---|---|---|---|
| PECA1_HUMAN | 243 | True | 2.4 | DCreg | DC1 | 3.7E-03 | 617024 | 436629 | 467035 | 1050892 |
| | 244 | True | 3.1 | DCreg | DC1 | 4.5E-02 | 617536 | 306513 | 424452 | 948411 |
| | 245 | True | 2.4 | DCreg | DC2 | 30.E-02 | 271527 | 232166 | 226470 | 532548 |
| | 246 | True | 1.4 | DCreg | DC1 | 3.2E-01 | 943851 | 722386 | 770221 | 1033031 |
| | 247 | True | 2.9 | DCreg | DC2 | 7.6E-03 | 442466 | 313856 | 266796 | 776220 |
| | 248 | True | 2.7 | DCreg | DC1 | 3.2E-03 | 266941 | 193853 | 256411 | 514688 |
| | 249 | True | 5.0 | DCreg | DC1 | 1.3E-01 | 18870 | 13533 | 14694 | 67126 |
| | 250 | True | 2.3 | DCreg | DC2 | 1.1E-02 | 253573 | 317836 | 237231 | 546558 |
| | 251 | True | 3.7 | DCreg | DC2 | 1.3E-02 | 169334 | 142039 | 103929 | 386866 |
| | 252 | True | 4.1 | DCreg | DC2 | 2.4E-03 | 146076 | 97769 | 94557 | 391981 |
| | 253 | True | 3.0 | DCreg | DC2 | 3.3E-02 | 128466 | 104356 | 94443 | 285019 |
| | 254 | True | 3.2 | DCreg | DC2 | 3.9E-01 | 106337 | 103892 | 89592 | 285806 |
| | 254 | True | 2.5 | DCreg | DC1 | 4.1E-02 | 33869 | 29317 | 33705 | 73646 |
| | 255 | True | 3.8 | DCreg | DC2 | 6.9E-01 | 112574 | 67626 | 62913 | 238863 |
| | 255 | True | 4.4 | DCreg | DC2 | 2.1E-01 | 46657 | 25707 | 21214 | 92675 |
| RNAS6_HUMAN | 256 | True | 5.6 | DCreg | DC2 | 1.4E-05 | 811673 | 272135 | 323560 | 1295597 |
| | 256 | True | 8.7 | DCreg | DC2 | 3.7E-06 | 1122177 | 337854 | 205808 | 1792978 |
| | 257 | True | 13.8 | DCreg | DC2 | 7.4E-02 | 214063 | 29704 | 25224 | 348226 |
| RNT2_HUMAN | 258 | True | 38.0 | DCreg | DC2 | 4.3E-04 | 274832 | 24804 | 15644 | 593717 |
| | 259 | True | 26.7 | DCreg | DC1 | 4.2E-01 | 40568 | 4495 | 5990 | 120188 |
| SOXB1_HUMAN | 260 | True | 13.9 | DCreg | DC1 | 6.0E-05 | 539560 | 87068 | 145358 | 1206365 |
| | 261 | True | 294.3 | DCreg | DC2 | 4.3E-04 | 31785 | 1021 | 657 | 193305 |

TABLE 6

Up-regulated DC2 markers

| A Type of proteins | Identification method | Swissprot accession no. | Protein name | Fold increase in mRNA (DC2 vs Ctrl-DCs) | Go annotation function (nextprot) |
|---|---|---|---|---|---|
| Up-regulated and validated proteins in DC2 | Microarray | CALCA | Calcitonin gene-related peptide 1 | ND | Hormone |
| | | CREM | cAMP-responsive element modulator | 24.7 | Activator, developmental protein, repressor, transcription regulation |
| | | FMOD | Fibromodulin | 34.9 | Extracellular matrix organization |
| | | GATA3 | Trans-acting T-cell-specific transcription factor GATA-3 | 64.8 | Transcription regulation |
| | | HCRTR1 | Orexin receptor type 1 | 11.0 | G-protein coupled receptor, Orexin receptor activity |
| | | ILDR2 | Immunoglobulin-like domain-containing receptor 2 | 13.7 | Cell differentiation, response to glucose |
| | | ITK | Tyrosine-protein kinase ITK/TSK | 97.0 | Adaptive immunity, tyrosine protein kinase |
| | | PADI2 | Protein-arginine deiminase type-2 | 38.8 | Hydrolase |
| | | PDE4D | cAMP-specific 3',5'-cyclic phosphodiesterase 4D | 26.7 | Hydrolase |
| | | PNOC | Prepronociceptin | ND | Neuropeptide, neurotransmitter |
| | | RGS9 | Regulator of G-protein signaling 9 | 258.9 | Signal transduction inhibitor |
| | | RIPK4 | Receptor-interacting serine/threonine-protein kinase 4 | 383.3 | Kinase |
| | | ROR1 | Tyrosine-protein kinase transmembrane receptor | ND | Kinase, transferase |
| | | SIX2 | Homeobox protein SIX2 | 201.5 | Developmental protein |
| | | SYT4 | Synaptotagmin-1 | ND | Calcium ion binding |
| | | THBS1 | Thrombospondin-1 | 615 | Cell adhesion |
| | | TRIM9 | E3 ubiquitin-protein ligase TRIM9 | 23.4 | Ligase |
| | Label-free MS | ADAM8 | Disintegrin and metalloproteinase domain-containing protein 8 | 3.3 | Hydrolase, metalloprotease, protease |
| | | CYTIP | Cytohesin-interacting protein | 5.8 | Protein binding, regulation of cell adhesion |
| | | NRP2 | Neuropilin-2 | 7.3 | Developmental protein, differentiation |
| | | SEMA7A | Semaphorin-7A | 15.1 | Developmental protein, differentiation, inflammatory response |
| | | TBC1D13 | TBC1 domain family member 13 | 8.6 | GTPase activation |
| | | CD141 | Thrombomodulin | ND | Blood coagulation, homeostasis, receptor |
| | | OX40L | Tumor necrosis factor ligand superfamily member 4 | 98.2 | Cytokine |

Down-regulated DC2 and up-regulated DCreg Markers

| B Type of proteins | Identification method | Swissprot accession no. | Protein name | Fold decrease in mRNA (Ctrl-DCs vs DC2) | Fold increase in mRNA (DCreg vs Ctrl-DCs) | Go annotation function (nextprot) |
|---|---|---|---|---|---|---|
| Down-regulated DC2 and up-regulated DCreg Markers | Label-free MS | IVNS1ABP | Influenza virus NS1A-binding protein | 5.8 | 4.8 | Host-virus interaction |
| | Microarray and label-free MS | FcγRIIA | Low affinity immunoglobulin gamma Fc region receptor II-a (IgG Fc receptor II-a) | 357 | 24.2 | Immunity, IgG binding |
| | Microarray | C3AR1 | C3a anaphylatoxin chemotactic receptor | 31 | 25.2 | Chemotaxis |
| | | CD163 | Scavenger receptor cysteine-rich type 1 protein M130 | 212.5 | 26.4 | Inflammatory response |
| | | FcεRIG | High affinity immunoglobulin epsilon receptor subunit gamma | 20.2 | 2.6 | Immunity, IgE receptor activity |
| | | FcγRIIIA | Low affinity immunoglobulin gamma Fc region receptor III-A | 357 | 4.6 | Immunity, IgG binding |
| | | MCTP1 | Multiple C2 and transmembrane domain-containing protein 1 | 26.7 | 2.3 | Calcium ion binding |
| | | SIGLEC5 | Sialic acid-binding Ig-like lectin 5 (Siglec-5) | 13 | 3.1 | Cell adhesion |
| | | C1QA | Complement C1q subcomponent subunit A | 46.4 | 8.8 | Compement subunit, innate immunity, signal transduction |

Up-regulated DCreg markers

| C Type of proteins | Identification method | Swissprot accession no. | Protein name | Fold increase in mRNA (DCreg vs Ctrl-DCs) | Go annotation function (nextprot) |
|---|---|---|---|---|---|
| Up-regulated and validated proteins in | Microarray | CD300LF | CMRF35-like molecule 1 | 30.4 | Immunity |
| | | CFH | Complement factor H | 14.9 | Complement alternate pathway, innate immunity |

TABLE 6-continued

| | | | | |
|---|---|---|---|---|
| DCreg | | CSGALNACT1 | Chondroitin sulfate N-acetylgalactosaminyltransferase 1 | 86.3 | Transferase |
| | | P2RY14 | P2Y purinoceptor 14 | 9.3 | G-protein coupled receptor |
| | | ZBTB16 | Zinc finger and BTB domain-containing protein 16 | 592.8 | Transcription regulation |
| | Microarray and label-free MS | FcγRIIB | Low affinity immunoglobulin gamma Fc region receptor II-b (IgG Fc receptor II-b) | 12.7 | Immunity, IgG binding |
| | Label-free MS | CYP1B1 | Cytochrome P450 1B1 | 4.3 | Oxidoreductase |
| | | DAB2 | Disabled homolog 2 | 4.2 | Apoptosis, differentiation, endocytosis |
| | | DPYD | Dihydropyrimidine dehydrogenase [NADP(+)] | 8.5 | Oxidoreductase |
| | | FTL | Ferritin light chain | 3.6 | Ion storage |
| | | GCLC | Glutamate--cysteine ligase catalytic subunit | 6 | Glutathione biosynthesis, ligase |
| | | LRRC25 | Leucine-rich repeat-containing protein 25 | 12 | Immunity? |
| | | NUDT16 | U8 snoRNA-decapping enzyme | 8.2 | Hydrolase |
| | | PDCD4 | Programmed cell death protein 4 | 3.8 | Apoptose |
| | | PECAM1 | Platelet endothelial cell adhesion molecule | 5.9 | Cell adhesion, phagocytosis |
| | | RNASE6 | Ribonuclease K6 | 3.6 | Endonuclease |
| | | RNASET2 | Ribonuclease T2 | 5.1 | Endonuclease, hydrolase |
| | | SLCO2B1 | Solute carrier organic anion transporter family member 2B1 | 8.2 | Ion transport |

SEQUENCE LISTING (261 sequences)

SEQ ID NO: 1 - protein, 770 aa, Homo sapiens
MSNEVETSATNGQPDQQAAPKAPSKKEKKKGPEKTDEYLLARFKGDGVKYKAKLIGIDDVPDARGDKMSQDSMMKLKGMAAAGRSQGQHKQRIWVNISLSGIKIIDEKTGVIEHEHPVNKISFIARDVTDNRAFGYVCGGEGQHQFFAIKTGQQAEPLVVDLKDLFQVIYNVKKKEEEKKKIEEASKAVENGSEALMILDDQTNKLKSGVDQMDLFGDMSTPPDLNSPTESKDILLVDLNSEIDTNQNSLRENPFLTNGITSCSLPRPTPQASFLPENAFSANLNFFPTPNPDPFRDDPFTQPDQSTPSSFDSLKSPDQKKENSSSSSTPLSNGPLNGDVDYFGQQFDQISNRTGKQEAQAGPWPFSSSQTQPAVRTQNGVSEREQNGFSVKSSPNPFVGSPPKGLSIQNGVKQDLESSVQSSPHDSIAIIPPPQSTKPGRGRRTAKSSANDLLASDIFAPPVSEPSGQASPTGQPTALQPNPLDLFKTSAPAPVGPLVGLGGVTVTLPQAGPWNTASLVFNQSPSMAPGAMMGGQPSGFSQPVIFGTSPAVSGWNQPSPFAASTPPPVPVVWGPSASVAPNAWSTTSPLGNPFQSNIFPAPAVSTQPPSMHSSLLVTPPQPPPRAGPPKDISSDAFTALDPLGDKEIKDVKEMFKDFQLRQPPAVPARKGEQTSSGTLSAFASYFNSKVGIPQENADHDDFDANQLLNKINEPPKPAPRQVSLPVTKSTDNAFENPFFKDSFGSSQASVASSQPVSSEMYRDPFGNPFA

SEQ ID NO: 2 - protein, 552 aa, Homo sapiens
MSNEVETSATNGQPDQQAAPKAPSKKEKKKGPEKTDEYLLARFKGDGVKYKAKLIGIDDVPDARGDKMSQDSMMKLKGMAAAGRSQGQHKQRIWVNISLSGIKIIDEKTGVIEHEHPVNKISFIARDVTDNRAFGYVCGGEGQHQFFAIKTGQQAEPLVVDLKDLFQVIYNVKKKEEEKKKIEEASKAVENGSEALMILDDQTNKLKSGVDQMDLFGDMSTPPDLNSPTSSANDLLASDIFAPPVSEPSGQASPTGQPTALQPNPLDLFKTSAPAPVGPLVGLGGVTVTLPQAGPWNTASLVFNQSPSMAPGAMMGGQPSGFSQPVIFGTSPAVSGWNQPSPFAASTPPPVPVVWGPSASVAPNAWSTTSPLGNPFQSNIFPAPAVSTQPPSMHSSLLVTPPQPPPRAGPPKDISSDAFTALDPLGDKEIKDVKEMFKDFQLRQPPAVPARKGEQTSSGTLSAFASYFNSKVGIPQENADHDDFDANQLLNKINEPPKPAPRQVSLPVTKSTDNAFENPFFKDSFGSSQASVASSQPVSSEMYRDPFGNPFA

SEQ ID NO: 3 - protein, 749 aa, Homo sapiens
MSNEVETSATNGQPDQQAAPKAPSKKEKKKGPEKTDEYLLARFKGDGVKYKAKLIGIDDVPDARGDKMSQDSMMKLKGMAAAGRSQGQHKQRIWVNISLSGIKIIDEKTGVIEHEHPVNKISFIARDVTDNRAFGYVCGGEGQHQFFAIKTGQQAEPLVVDLKDLFQVIYNVKKKEEEKKKIEEASKAVENGSEALMILDDQTNKLKSESKDILLVDLNSEIDTNQNSLRENPFLTNGITSCSLPRPTPQASFLPENAFSANLNFFPTPNPDPFRDDPFTQPDQSTPSSFDSLKSPDQKKENSSSSSTPLSNGPLNGDVDYFGQQFDQISNRTGKQEAQAGPWPFSSSQTQPAVRTQNGVSEREQNGFSVKSSPNPFVGSPPKGLSIQNGVKQDLESSVQSSPHDSIAIIPPPQSTKPGRGRRTAKSSANDLLASDIFAPPVSEPSGQASPTGQPTALQPNPLDLFKTSAPAPVGPLVGLGGVTVTLPQAGPWNTASLVFNQSPSMAPGAMMGGQPSGFSQPVIFGTSPAVSGWNQPSPFAASTPPPVPVVWGPSASVAPNAWSTTSPLGNPFQSNIFPAPAVSTQPPSMHSSLLVTPPQPPPRAGPPKDISSDAFTALDPLGDKEIKDVKEMFKDFQLRQPPAVPARKGEQTSSGTLSAFASYFNSKVGIPQENADHDDFDANQLLNKINEPPKPAPRQVSLPVTKSTDNAFENPFFKDSFGSSQASVASSQPVSSEMYRDPFGNPFA

SEQ ID NO: 4 - protein, 317 aa, Homo sapiens
MTMETQMSQNVCPRNLWLLQPLTVLLLLASADSQAAAPPKAVLKLEPPWINVLQEDSVTLTCQGARSPESDSIQWFHNGNLIPTHTQPSYRFKANNNDSGEYTCQTGQTSLSDPVHLTVLSEWLVLQTPHLEFQEGETIMLRCHSWKDKPLVKVTFFQNGKSQKFSHLDPTFSIPQANHSHSGDYHCTGNIGYTLFSSKPVTITVQVPSMGSSSPMGIIVAVVIATAVAAIVAAVVALIYCRKKRISANSTDPVKAAQFEPPGRQMIAIRKRQLEETNNDYETADGGYMTLNPRAPTDDDKNIYLTLPPNDHVNSNN

SEQ ID NO: 5 - protein, 316 aa, Homo sapiens
MTMETQMSQNVCPRNLWLLQPLTVLLLLASADSQAAPPKAVLKLEPPWINVLQEDSVTLTCQGARSPESDSIQWFHNGNLIPTHTQPSYRFKANNNDSGEYTCQTGQTSLSDPVHLTVLSEWLVLQTPHLEFQEGETIMLRCHSWKDKPLVKVTFFQNGKSQKFSHLDPTFSIPQANHSHSGDYHCTGNIGYTLFSSKPVTITVQVPSMGSSSPMGIIVAVVIATAVAAIVAAVVALIYCRKKRISANSTDPVKAAQFEPPGRQMIAIRKRQLEETNNDYETADGGYMTLNPRAPTDDDKNIYLTLPPNDHVNSNN

SEQ ID NO: 6 - protein, 175 aa, Homo sapiens
MSSQIRQNYSTDVEAAVNSLVNLYLQASYTYLSLGFYFDRDDVALEGVSHFFRELAEEKREGYERLLKMQNQRGGRALFQDIKKPAEDEWGKTPDAMKAAMALEKKLNQALLDLHALGSARTDPHLCDFLETHFLDEEVKLIKKMGDHLTNLHRLGGPEAGLGEYLFERLTLKHD

SEQ ID NO: 7 - protein, 738 aa, Homo sapiens
MQPRWAQGATMWLGVLLTLLLCSSLEGQENSFTINSVDMKSLPDWTVQNGKNLTLQCFADVSTTSHVKPQHQMLFYKDDVLFYNISSMKSTESYFIPEVRIYDSGTYKCTVIVNNKEKTTAEYQLLVEGVPSPRVTLDKKEAIQGGIVRVNCSVPEEKAPIHFTIEKLELNEKMVKLKREKNSRDQNFVILEFPVEEQDRVLSFRCQARIISGIHMQTSESTKSELVTVTESFSTPKFHISPTGMIMEGAQLHIKCTIQVTHLAQEFPEIIIQKDKAIVAHNRHGNKAVYSVMAMVEHSGNYTCKVESSRISKVSSIVVNITELFSKPELESSFTHLDQGERLNLSCSIPGAPPANFTIQKEDTIVSQTQDFTKIASKSDSGTYICTAGIDKVVKKSNTVQIVVCEMLSQPRISYDAQFEVIKGQTIEVRCESISGTLPISYQLLKTSKVLENSTKNSNDPAVFKDNPTEDVEYQCVADNCHSHAKMLSEVLRVKVIAPVDEVQISILSSKVVESGEDIVLQCAVNEGSGPITYKFYREKEGKPFYQMTSNATQAFWTKQKASKEQEGEYYCTAFNRANHASSVPRSKILTVRVILAPWKKGLIAVVIIGVIIALLIIAAKCYFLRKAKAKQMPVEMSRPAVPLLNSNNEKMSDPNMEANSHYGHNDDVRNHAMKPINDNKEPLNSDVQYTEVQVSSAESHKDLGKKDTETVYSEVRKAVPDAVESRYSRTEGSLDGT

SEQ ID NO: 8 - protein, 720 aa, Homo sapiens
MQPRWAQGATMWLGVLLTLLLCSSLEGQENSFTINSVDMKSLPDWTVQNGKNLTLQCFADVSTTSHVKPQHQMLFYKDDVLFYNISSMKSTESYFIPEVRIYDSGTYKCTVIVNNKEKTTAEYQLLVEGVPSPRVTLDKKEAIQGGIVRVNCSVPEEKAPIHFTIEKLELNEKMVKLKREKNSRDQNFVILEFPVEEQDRVLSFRCQARIISGIHMQTSESTKSELVTVTESFSTPKFHISPTGMIMEGAQLHIKCTIQVTHLAQEFPEIIIQKDKAIVAHNRHGNKAVYSVMAMVEHSGNYTCKVESSRISKVSSIVVNITELFSKPELESSFTHLDQGERLNLSCSIPGAPPANFTIQKEDTIVSQTQDFTKIASKSDSGTYICTAGIDKVVKKSNTVQIVVCEMLSQPRISYDAQFEVIKGQTIEVRCESISGTLPISYQLLKTSKVLENSTKNSNDPAVFKDNPTEDVEYQCVADNCHSHAKMLSEVLRVKVIAPVDEVQISILSSKVVESGEDIVLQCAVNEGSGPITYKFYREKEGKPFYQMTSNATQAFWTKQKASKEQEGEYYCTAFNRANHASSVPRSKILTVRVILAPWKKGLIAVVIIGVIIALLIIAAKCYFLRKAKAKQMPVEMSRPAVPLLNSNNEKMSDPNMEANSHYEPLNSDVQYTEVQVSSAESHKDLGKKDTETVYSEVRKAVPDAVESRYSRTEGSLDGT

SEQ ID NO: 9 - protein, 717 aa, Homo sapiens
MQPRWAQGATMWLGVLLTLLLCSSLEGQENSFTINSVDMKSLPDWTVQNGKNLTLQCFADVSTTSHVKPQHQMLFYKDDVLFYNISSMKSTESYFIPEVRIYDSGTYKCTVIVNNKEKTTAEYQLLVEGVPSPRVTLDKKEAIQGGIVRVNCSVPEEKAPIHFTIEKLELNEKMVKLKREKNSRDQNFVILEFPVEEQDRVLSFRCQARIISGIHMQTSESTKSELVTVTESFSTPKFHISPTGMIMEGAQLHIKCTIQVTHLAQEFPEIIIQKDKAIVAHNRHGNKAVYSVMAMVEHSGNYTCKVESSRISKVSSIVVNITELFSKPELESSFTHLDQGERLNLSCSIPGAPPANFTIQKEDTIVSQTQDFTKIASKSDSGTYICTAGIDKVVKKSNTVQIVVCEMLSQPRISYDAQFEVIKGQTIEVRCESISGTLPISYQLLKTSKVLENSTKNSNDPAVFKDNPTEDVEYQCVADNCHSHAKMLSEVLRVKVIAPVDEVQISILSSKVVESGEDIVLQCAVNEGSGPITYKFYREKEGKPFYQMTSNATQAFWTKQKASKEQEGEYYCTAFNRANHASSVPRSKILTVRVILAPWKKGLIAVVIIGVIIALLIIAAKCYFLRKAKAKQMPVEMSRPAVPLLNSNNEKMSDPNMEANSHYGHNDDVRNHAMKPINDNKDLGKKDTETVYSEVRKAVPDAVESRYSRTEGSLDGT

SEQ ID NO: 10 - protein, 719 aa, Homo sapiens
MQPRWAQGATMWLGVLLTLLLCSSLEGQENSFTINSVDMKSLPDWTVQNGKNLTLQCFADVSTTSHVKPQHQMLFYKDDVLFYNISSMKSTESYFIPEVRIYDSGTYKCTVIVNNKEKTTAEYQLLVEGVPSPRVTLDKKEAIQGGIVRVNCSVPEEKAPIHFTIEKLELNEKMVKLKREKNSRDQNFVILEFPVEEQDRVLSFRCQARIISGIHMQTSESTKSELVTVTESFSTPKFHISPTGMIMEGAQLHIKCTIQVTHLAQEFPEIIIQKDKAIVAHNRHGNKAVYSVMAMVEHSGNYTCKVESSRISKVSSIVVNITELFSKPELESSFTHLDQGERLNLSCSIPGAPPANFTIQKEDTIVSQTQDFTKIASKSDSGTYICTAGIDKVVKKSNTVQIVVCEMLSQPRISYDAQFEVIKGQTIEVRCESISGTLPISYQLLKTSKVLENSTKNSNDPAVFKDNPTEDVEYQCVADNCHSHAKMLSEVLRVKVIAPVDEVQISILSSKVVESGEDIVLQCAVNEGSGPITYKFYREKEGKPFYQMTSNATQAFWTKQKASKEQEGEYYCTAFNRANHASSVPRSKILTVRVILAPWKKGLIAVVIIGVIIALLIIAAKCYFLRKAKAKQMPVEMSRPAVPLLNSNNEKMSDPNMEANSHYGHNDDVRNHAMKPINDNKEPLNSDVQYTEVQVSSAESHKDAVESRYSRTEGSLDGT

SEQ ID NO: 11 - protein, 708 aa, Homo sapiens
MQPRWAQGATMWLGVLLTLLLCSSLEGQENSFTINSVDMKSLPDWTVQNGKNLTLQCFADVSTTSHVKPQHQMLFYKDDVLFYNISSMKSTESYFIPEVRIYDSGTYKCTVIVNNKEKTTAEYQLLVEGVPSPRVTLDKKEAIQGGIVRVNCSVPEEKAPIHFTIEKLELNEKMVKLKREKNSRDQNFVILEFPVEEQDRVLSFRCQARIISGIHMQTSESTKSELVTVTESFSTPKFHISPTGMIMEGAQLHIKCTIQVTHLAQEFPEIIIQKDKAIVAHNRHGNKAVYSVMAMVEHSGNYTCKVESSRISKVSSIVVNITELFSKPELESSFTHLDQGERLNLSCSIPGAPPANFTIQKEDTIVSQTQDFTKIASKSDSGTYICTAGIDKVVKKSNTVQIVVCEMLSQPRISYDAQFEVIKGQTIEVRCESISGTLPISYQLLKTSKVLENSTKNSNDPAVFKDNPTEDVEYQCVADNCHSHAKMLSEVLRVKVIAPVDEVQISILSSKVVESGEDIVLQCAVNEGSGPITYKFYREKEGKPFYQMTSNATQAFWTKQKASKEQEGEYYCTAFNRANHASSVPRSKILTVRVILAPWKKGLIAVVIIGVIIALLIIAAKCYFLRKAKAKQMPVEMSRPAVPLLNSNNEKMSDPNMEANSHYGHNDDVRNHAMKPINDNKEPLNSDVQYTEVQVSSAESHKENGRLP

SEQ ID NO: 12 - protein, 727 aa, Homo sapiens
MQPRWAQGATMWLGVLLTLLLCSSLEGQENSFTINSVDMKSLPDWTVQNGKNLTLQCFADVSTTSHVKPQHQMLFYKDDVLFYNISSMKSTESYFIPEVRIYDSGTYKCTVIVNNKEKTTAEYQLLVEGVPSPRVTLDKKEAIQGGIVRVNCSVPEEKAPIHFTIEKLELNEKMVKLKREKNSRDQNFVILEFPVEEQDRVLSFRCQARIISGIHMQTSESTKSELVTVTESFSTPKFHISPTGMIMEGAQLHIKCTIQVTHLAQEFPEIIIQKDKAIVAHNRHGNKAVYSVMAMVEHSGNYTCKVESSRISKVSSIVVNITELFSKPELESSFTHLDQGERLNLSCSIPGAPPANFTIQKEDTIVSQTQDFTKIASKSDSGTYICTAGIDKVVKKSNTVQIVVCEMLSQPRISYDAQFEVIKGQTIEVRCESISGTLPISYQLLKTSKVLENSTKNSNDPAVFKDNPTEDVEYQCVADNCHSHAKMLSEVLRVKVIAPVDEVQISILSSKVVESGEDIVLQCAVNEGSGPITYKFYREKEGKPFYQMTSNATQAFWTKQKASKEQEGEYYCTAFNRANHASSVPRSKILTVRVILAPWKKGLIAVVIIGVIIALLIIAAKCYFLRKAKAKQMPVEMSRPAVPLLNSNNEKMSDPNMEANSHYGHNDDVRNHAMKPINDNKEPLNSDVQYTEVQVSSAESHKDLGKKDTETVYSEVRKAVPENGRLP

SEQ ID NO: 13 - protein, 709 aa, Homo sapiens
MGPRIGPAGEVPQVPDKETKATMGTENTPGGKASPDPQDVRPSVFHNIKLFVLCHSLLQLAQLMISGYLKSSISTVEKRFGLSSQTSGLLASFNEVGNTALIVFVSYFGSRVHRPRMIGYGAILVALAGLLMTLPHFISEPYRYDNTSPEDMPQDFKASLCLPTTSAPASAPSNGNCSSYTETQHLSVVGIMFVAQTLLGVGGVPIQPFGISYIDDFAHNSNSPLYLGILFAVTMMGPGLAFGLGSLMLRLYVDINQMPEGGISLTIKDPRWVGAWWLGFLIAAGAVALAAIPYFFFPKEMPKEKRELQFRRKVLAVTDSPARKGKDSPSKQSPGESTKKQDGLVQIAPNLTVIQFIKVFPRVLLQTLRHPIFLLVVLSQVCLSSMAAGMAIFLPKFLERQFSITASYANLLIGCLSFPSVIVGIVVGGVLVKRLHLGPVGCGALCLLGMLLCLFFSLPLFFIGCSSHQIAGITHQTSAHPGLELSPSCMEACSCPLDGFNPVCDPSTRVEYITPCHAGCSSWVVQDALDNSQVFYTNCSCVVEGNPVLAGSCDSTCSHLVVPFLLLVSLGSALACLTHTPSFMLILRGVKKEDKTLAVGIQFMFLRILAWMPSPVIHGSAIDTTCVHWALSCGRRAVCRYYNNDLLRNRFIGLQFFFKTGSVICFALVLAVLRQQDKEARTKESRSSPAVEQQLLVSGPGKKPEDSRV

SEQ ID NO: 14 - protein, 482 aa, Homo sapiens
MIGYGAILVALAGLLMTLPHFISEPYRYDNTSPGGISLTIKDPRWVGAWWLGFLIAAGAVALAAIPYFFFPKEMPKEKRELQFRRKVLAVTDSPARKGKDSPSKQSPGESTKKQDGLVQIAPNLTVIQFIKVFPRVLLQTLRHPIFLLVVLSQVCLSSMAAGMAIFLPKFLERQFSITASYANLLIGCLSFPSVIVGIVVGGVLVKRLHLGPVGCGALCLLGMLLCLFFSLPLFFIGCSSHQIAGITHQTSAHPGLELSPSCMEACSCPLDGFNPVCDPSTRVEYITPCHAGCSSWVVQDALDNSQVFYTNCSCVVEGNPVLAGSCDSTCSHLVVPFLLLVSLGSALACLTHTPSFMLILRGVKKEDKTLAVGIQFMFLRILAWMPSPVIHGSAIDTTCVHWALSCGRRAVCRYYNNDLLRNRFIGLQFFFKTGSVICFALVLAVLRQQDKEARTKESRSSPAVEQQLLVSGPGKKPEDSRV

SEQ ID NO: 15 - protein, 687 aa, Homo sapiens
MGTENTPGGKASPDPQDVRPSVFHNIKLFVLCHSLLQLAQLMISGYLKSSISTVEKRFGLSSQTSGLLASFNEVGNTALIVFVSYFGSRVHRPRMIGYGAILVALAGLLMTLPHFISEPYRYDNTSPEDMPQDFKASLCLPTTSAPASAPSNGNCSSYTETQHLSVVGIMFVAQTLLGVGGVPIQPFGISYIDDFAHNSNSPLYLGILFAVTMMGPGLAFGLGSLMLRLYVDINQMPEGGISLTIKDPRWVGAWWLGFLIAAGAVALAAIPYFFFPKEMPKEKRELQFRRKVLAVTDSPARKGKDSPSKQSPGESTKKQDGLVQIAPNLTVIQFIKVFPRVLLQTLRHPIFLLVVLSQVCLSSMAAGMAIFLPKFLERQFSITASYANLLIGCLSFPSVIVGIVVGGVLVKRLHLGPVGCGALCLLGMLLCLFFSLPLFFIGCSSHQIAGITHQTSAHPGLELSPSCMEACSCPLDGFNPVCDPSTRVEYITPCHAGCSSWVVQDALDNSQVFYTNCSCVVEGNPVLAGSCDSTCSHLVVPFLLLVSLGSALACLTHTPSFMLILRGVKKEDKTLAVGIQFMFLRILAWMPSPVIHGSAIDTTCVHWALSCGRRAVCRYYNNDLLRNRFIGLQFFFKTGSVICFALVLAVLRQQDKEARTKESRSSPAVEQQLLVSGPGKKPEDSRV

SEQ ID NO: 16 - protein, 565 aa, Homo sapiens
MGPRIEDMPQDFKASLCLPTTSAPASAPSNGNCSSYTETQHLSVVGIMFVAQTLLGVGGVPIQPFGISYIDDFAHNSNSPLYLGILFAVTMMGPGLAFGLGSLMLRLYVDINQMPEGGISLTIKDPRWVGAWWLGFLIAAGAVALAAIPYFFFPKEMPKEKRELQFRRKVLAVTDSPARKGKDSPSKQSPGESTKKQDGLVQIAPNLTVIQFIKVFPRVLLQTLRHPIFLLVVLSQVCLSSMAAGMAIFLPKFLERQFSITASYANLLIGCLSFPSVIVGIVVGGVLVKRLHLGPVGCGALCLLGMLLCLFFSLPLFFIGCSSHQIAGITHQTSAHPGLELSPSCMEACSCPLDGFNPVCDPSTRVEYITPCHAGCSSWVVQDALDNSQVFYTNCSCVVEGNPVLAGSCDSTCSHLVVPFLLLVSLGSALACLTHTPSFMLILRGVKKEDKTLAVGIQFMFLRILAWMPSPVIHGSAIDTTCVHWALSCGRRAVCRYYNNDLLRNRFIGLQFFFKTGSVICFALVLAVLRQQDKEARTKESRSSPAVEQQLLVSGPGKKPEDSRV

SEQ ID NO: 17 - protein, 482 aa, Homo sapiens
MASFSAETNSTDLLSQPWNEPPVILSMVILSLTFLLGLPGNGLVLWVAGLKMQRTVNTIWFLHLTLADLLCCLSLPFSLAHLALQGQWPYGRFLCKLIPSIIVLNMFASVFLLTAISLDRCLVVFKPIWCQNHRNVGMACSICGCIWVVAFVMCIPVFVYREIFTTDNHNRCGYKFGLSSSLDYPDFYGDPLENRSLENIVQPPGEMNDRLDPSSFQTNDHPWTVPTVFQPQTFQRPSADSLPRGSARLTSQNLYSNVFKPADVVSPKIPSGFPIEDHETSPLDNSDAFLSTHLKLFPSASSNSFYESELPQGFQDYYNLGQFTDDDQVPTPLVAITITRLVVGFLLPSVIMIACYSFIVFRMQRGRFAKSQSKTFRVAVVVVAVFLVCWTPYHIFGVLSLLTDPETPLGKTLMSWDHVCIALASANSCFNPFLYALLGKDFRKKARQSIQGILEAAFSEELTRSTHCPSNNVISERNSTTV

SEQ ID NO: 18 - protein, 1156 aa, Homo sapiens
MSKLRMVLLEDSGSADFRRHFVNLSPFTITVVLLLSACFVTSSLGGTDKELRLVDGENKCSGRVEVKVQEEWGTVCNNGWSMEAVSVICNQLGCPTAIKAPGWANSSAGSGRIWMDHVSCRGNESALWDCKHDGWGKHSNCTHQQDAGVTCSDGSNLEMRLTRGGNMCSGRIEIKFQGRWGTVCDDNFNIDHASVICRQLECGSAVSFSGSSNFGEGSGPIWFDDLICNGNESALWNCKHQGWGKHNCDHAEDAGVICSKGADLSLRLVDGVTECSGRLEVRFQGEWGTICDDGWDSYDAAVACKQLGCPTAVTAIGRVNASKGFGHIWLDSVSCQGHEPAIWQCKHHEWGKHYCNHNEDAGVTCSDGSDLELRLRGGGSRCAGTVEVEIQRLLGKVCDRGWGLKEADVVCRQLGCGSALKTSYQVYSKIQATNTWLFLSSCNGNETSLWDCKNWQWGGLTCDHYEEAKITCSAHREPRLVGGDIPCSGRVEVKHGDTWGSICDSDFSLEAASVLCRELQCGTVVSILGGAHFGEGNGQIWAEEFQCEGHESHLSLCPVAPRPEGTCSHSRDVGVVCSRYTEIRLVNGKTPCEGRVELKTLGAWGSLCNSHWDIEDAHVLCQQLKCGVALSTPGGARFGKGNGQIWRHMFHCTGTEQHMGDCPVTALGASLCPSEQVASVICSGNQSQTLSSCNSSSLGPTRPTIPEESAVACIESGQLRLVNGGGRCAGRVEIYHEGSWGTICDDSWDLSDAHVVCRQLGCGEAINATGSAHFGEGTGPIWLDEMKCNGKESRIWQCHSHGWGQQNCRHKEDAGVICSEFMSLRLTSEASREACAGRLEVFYNGAWGTVGKSSMSETTVGVVCRQLGCADKGKINPASLDKAMSIPMWVDNVQCPKGPDTLWQCPSSPWEKRLASPSEETWITCDNKIRLQEGPTSCSGRVEIWHGGSWGTVCDDSWDLDDAQVVCQQLGCGPALKAFKEAEFGQGTGPIWLNEVKCKGNESSLWDCPARRWGHSECGHKEDAAVNCTDISVQKTPQKATTGRSSRQSSFIAVGILGVVLLAIFVALFFLTKKRRQRQRLAVSSRGENLVHQIQYREMNSCLNADDLDLMNSSENSHESADFSAAELISVSKFLPISGMEKEAILSHTEKENGNL

SEQ ID NO: 19 - protein, 1161 aa, Homo sapiens
MSKLRMVLLEDSGSADFRRHFVNLSPFTITVVLLLSACFVTSSLGGTDKELRLVDGENKCSGRVEVKVQEEWGTVCNNGWSMEAVSVICNQLGCPTAIKAPGWANSSAGSGRIWMDHVSCRGNESALWDCKHDGWGKHSNCTHQQDAGVTCSDGSNLEMRLTRGGNMCSGRIEIKFQGRWGTVCDDNFNIDHASVICRQLECGSAVSFSGSSNFGEGSGPIWFDDLICNGNESALWNCKHQGWGKHNCDHAEDAGVICSKGADLSLRLVDGVTECSGRLEVRFQGEWGTICDDGWDSYDAAVACKQLGCPTAVTAIGRVNASKGFGHIWLDSVSCQGHEPAIWQCKHHEWGKHYCNHNEDAGVTCSDGSDLELRLRGGGSRCAGTVEVEIQRLLGKVCDRGWGLKEADVVCRQLGCGSALKTSYQVYSKIQATNTWLFLSSCNGNETSLWDCKNWQWGGLTCDHYEEAKITCSAHREPRLVGGDIPCSGRVEVKHGDTWGSICDSDFSLEAASVLCRELQCGTVVSILGGAHFGEGNGQIWAEEFQCEGHESHLSLCPVAPRPEGTCSHSRDVGVVCSRYTEIRLVNGKTPCEGRVELKTLGAWGSLCNSHWDIEDAHVLCQQLKCGVALSTPGGARFGKGNGQIWRHMFHCTGTEQHMGDCPVTALGASLCPSEQVASVICSGNQSQTLSSCNSSSLGPTRPTIPEESAVACIESGQLRLVNGGGRCAGRVEIYHEGSWGTICDDSWDLSDAHVVCRQLGCGEAINATGSAHFGEGTGPIWLDEMKCNGKESRIWQCHSHGWGQQNCRHKEDAGVICSEFMSLRLTSEASREACAGRLEVFYNGAWGTVGKSSMSETTVGVVCRQLGCADKGKINPASLDKAMSIPMWVDNVQCPKGPDTLWQCPSSPWEKRLASPSEETWITCDNKIRLQEGPTSCSGRVEIWHGGSWGTVCDDSWDLDDAQVVCQQLGCGPALKAFKEAEFGQGTGPIWLNEVKCKGNESSLWDCPARRWGHSECGHKEDAAVNCTDISVQKTPQKATTGRSSRQSSFIAVGILGVVLLAIFVALFFLTKKRRQRQRLAVSSRGENLVHQIQYREMNSCLNADDLDLMNSSGLWVLGGSIAQGFRSVAAVEAQTFYFDKQLKKSKNVIGSLDAYNGQE

SEQ ID NO: 20 - protein, 1121 aa, Homo sapiens
MSKLRMVLLEDSGSADFRRHFVNLSPFTITVVLLLSACFVTSSLGGTDKELRLVDGENKCSGRVEVKVQEEWGTVCNNGWSMEAVSVICNQLGCPTAIKAPGWANSSAGSGRIWMDHVSCRGNESALWDCKHDGWGKHSNCTHQQDAGVTCSDGSNLEMRLTRGGNMCSGRIEIKFQGRWGTVCDDNFNIDHASVICRQLECGSAVSFSGSSNFGEGSGPIWFDDLICNGNESALWNCKHQGWGKHNCDHAEDAGVICSKGADLSLRLVDGVTECSGRLEVRFQGEWGTICDDGWDSYDAAVACKQLGCPTAVTAIGRVNASKGFGHIWLDSVSCQGHEPAIWQCKHHEWGKHYCNHNEDAGVTCSDGSDLELRLRGGGSRCAGTVEVEIQRLLGKVCDRGWGLKEADVVCRQLGCGSALKTSYQVYSKIQATNTWLFLSSCNGNETSLWDCKNWQWGGLTCDHYEEAKITCSAHREPRLVGGDIPCSGRVEVKHGDTWGSICDSDFSLEAASVLCRELQCGTVVSILGGAHFGEGNGQIWAEEFQCEGHESHLSLCPVAPRPEGTCSHSRDVGVVCSRYTEIRLVNGKTPCEGRVELKTLGAWGSLCNSHWDIEDAHVLCQQLKCGVALSTPGGARFGKGNGQIWRHMFHCTGTEQHMGDCPVTALGASLCPSEQVASVICSGNQSQTLSSCNSSSLGPTRPTIPEESAVACIESGQLRLVNGGGRCAGRVEIYHEGSWGTICDDSWDLSDAHVVCRQLGCGEAINATGSAHFGEGTGPIWLDEMKCNGKESRIWQCHSHGWGQQNCRHKEDAGVICSEFMSLRLTSEASREACAGRLEVFYNGAWGTVGKSSMSETTVGVVCRQLGCADKGKINPASLDKAMSIPMWVDNVQCPKGPDTLWQCPSSPWEKRLASPSEETWITCDNKIRLQEGPTSCSGRVEIWHGGSWGTVCDDSWDLDDAQVVCQQLGCGPALKAFKEAEFGQGTGPIWLNEVKCKGNESSLWDCPARRWGHSECGHKEDAAVNCTDISVQKTPQKATTGRSSRQSSFIAVGILGVVLLAIFVALFFLTKKRRQRQRLAVSSRGENLVHQIQYREMNSCLNADDLDLMNSSGGHSEPH

SEQ ID NO: 21 - protein, 1154 aa, Homo sapiens
MSKLRMVLLEDSGSADFRRHFVNLSPFTITVVLLLSACFVTSSLGGTDKELRLVDGENKCSGRVEVKVQEEWGTVCNNGWSMEAVSVICNQLGCPTAIKAPGWANSSAGSGRIWMDHVSCRGNESALWDCKHDGWGKHSNCTHQQDAGVTCSDGSNLEMRLTRGGNMCSGRIEIKFQGRWGTVCDDNFNIDHASVICRQLECGSAVSFSGSSNFGEGSGPIWFDDLICNGNESALWNCKHQGWGKHNCDHAEDAGVICSKGADLSLRLVDGVTECSGRLEVRFQGEWGTICDDGWDSYDAAVACKQLGCPTAVTAIGRVNASKGFGHIWLDSVSCQGHEPAIWQCKHHEWGKHYCNHNEDAGVTCSDGSDLELRLRGGGSRCAGTVEVEIQRLLGKVCDRGWGLKEADVVCRQLGCGSALKTSYQVYSKIQATNTWLFLSSCNGNETSLWDCKNWQWGGLTCDHYEEAKITCSAHREPRLVGGDIPCSGRVEVKHGDTWGSICDSDFSLEAASVLCRELQCGTVVSILGGAHFGEGNGQIWAEEFQCEGHESHLSLCPVAPRPEGTCSHSRDVGVVCSSKTQKTSLIGSYTVKGTGLGSHSCLFLKPCLLPGYTEIRLVNGKTPCEGRVELKTLGAWGSLCNSHWDIEDAHVLCQQLKCGVALSTPGGARFGKGNGQIWRHMFHCTGTEQHMGDCPVTALGASLCPSEQVASVICSGNQSQTLSSCNSSSLGPTRPTIPEESAVACIESGQLRLVNGGGRCAGRVEIYHEGSWGTICDDSWDLSDAHVVCRQLGCGEAINATGSAHFGEGTGPIWLDEMKCNGKESRIWQCHSHGWGQQNCRHKEDAGVICSEFMSLRLTSEASREACAGRLEVFYNGAWGTVGKSSMSETTVGVVCRQLGCADKGKINPASLDKAMSIPMWVDNVQCPKGPDTLWQCPSSPWEKRLASPSEETWITCDNKIRLQEGPTSCSGRVEIWHGGSWGTVCDDSWDLDDAQVVCQQLGCGPALKAFKEAEFGQGTGPIWLNEVKCKGNESSLWDCPARRWGHSECGHKEDAAVNCTDISVQKTPQKATTGRSSRQSSFIAVGILGVVLLAIFVALFFLTKKRRQRQRLAVSSRGENLVHQIQYREMNSCLNADDLDLMNSSGGHSEPH

SEQ ID NO: 22 - protein, 290 aa, Homo sapiens
MPLLTLYLLLFWLSGYSIVTQITGPTTVNGLERGSLTVQCVYRSGWETYLKWWCRGAIWRDCKILVKTSGSEQEVKRDRVSIKDNQKNRTFTVTMEDLMKTDADTYWCGIEKTGNDLGVTVQVTIDPAPVTQEETSSSPTLTGHHLDNRHKLLKLSVLLPLIFTILLLLLVAASLLAWRMMKYQQKAAGMSPEQVLQPLEGDLCYADLTLQLAGTSPQKATTKLSSAQVDQVEVEYVTMASLPKEDISYASLTLGAEDQEPTYCNMGHLSSHLPGRGPEEPTEYSTISRP

SEQ ID NO: 23 - protein, 239 aa, Homo sapiens
MWLPQLDLMRVISAKSQGYSIVTQITGPTTVNGLERGSLTVQCVYRSGWETYLKWWCRGAIWRDCKILVKTSGSEQEVKRDRVSIKDNQKNRTFTVTMEDLMKTDADTYWCGIEKTGNDLGVTVQVTIDPASTPAPTTPTSTTFTAPVTQEETSSSPTLTGHHLDNRHKLLKLSVLLPLIFTILLLLLVAASLLAWRMMKYQQKGTAAPGGRPLLCRPDPAAGRNLPAKGYHEAFLCPG

SEQ ID NO: 24 - protein, 165 aa, Homo sapiens
MWLPQLDLMRVISAKSQGYSIVTQITGPTTVNGLERGSLTVQCVYRSGWETYLKWWCRGAIWRDCKILVKTSGSEQEVKRDRVSIKDNQKNRTFTVTMEDLMKTDADTYWCGIEKTGNDLGVTVQVTIDPAPVTQEETSSSPTLTGHHLDNRYCSPWRATSAMQT

SEQ ID NO: 25 - protein, 194 aa, Homo sapiens
MWLPQLDLMRVISAKSQGYSIVTQITGPTTVNGLERGSLTVQCVYRSGWETYLKWWCRGAIWRDCKILVKTSGSEQEVKRDRVSIKDNQKNRTFTVTMEDLMKTDADTYWCGIEKTGNDLGVTVQVTIDPAPVTQEETSSSPTLTGHHLDNSSRDVPRAGTAAPGGRPLLCRPDPAAGRNLPAKGYHEAFLCPG

SEQ ID NO: 26 - protein, 244 aa, Homo sapiens
MPLLTLYLLLFWLSGYSIVTQITGPTTVNGLERGSLTVQCVYRSGWETYLKWWCRGAIWRDCKILVKTSGSEQEVKRDRVSIKDNQKNRTFTVTMEDLMKTDADTYWCGIEKTGNDLGVTVQVTIDPAPVTQEETSSSPTLTGHHLDNRSEGSQAANYRPAAHQAQAPEAQCPPAPHLHHIAAAFGGRLTLGLEDDEVPAESSRDVPRAGTAAPGGRPLLCRPDPAAGRNLPAKGYHEAFLCPG

SEQ ID NO: 27 - protein, 293 aa, Homo sapiens
MWLPQLDLMRVISAKSQGYSIVTQITGPTTVNGLERGSLTVQCVYRSGWETYLKWWCRGAIWRDCKILVKTSGSEQEVKRDRVSIKDNQKNRTFTVTMEDLMKTDADTYWCGIEKTGNDLGVTVQVTIDPAPVTQEETSSSPTLTGHHLDNRHKLLKLSVLLPLIFTILLLLLVAASLLAWRMMKYQQKAAGMSPEQVLQPLEGDLCYADLTLQLAGTSPQKATTKLSSAQVDQVEVEYVTMASLPKEDISYASLTLGAEDQEPTYCNMGHLSSHLPGRGPEEPTEYSTISRP

SEQ ID NO: 28 - protein, 1231 aa, Homo sapiens
MRLLAKIICLMLWAICVAEDCNELPPRRNTEILTGSWSDQTYPEGTQAIYKCRPGYRSLGNVIMVCRKGEWVALNPLRKCQKRPCGHPGDTPFGTFTLTGGNVFEYGVKAVYTCNEGYQLLGEINYRECDTDGWTNDIPICEVVKCLPVTAPENGKIVSSAMEPDREYHFGQAVRFVCNSGYKIEGDEEMHCSDDGFWSKEKPKCVEISCKSPDVINGSPISQKIIYKENERFQYKCNMGYEYSERGDAVCTESGWRPLPSCEEKSCDNPYIPNGDYSPLRIKHRTGDEITYQCRNGFYPATRGNTAKCTSTGWIPAPRCTLKPCDYPDIKHGGLYHENMRRPYFPVAVGKYYSYYCDEHFETPSGSYWDHIHCTQDGWSPAVPCLRKCYFPYLENGYNQNYGRKFVQGKSIDVACHPGYALPKAQTTVTCMENGWSPTPRCIRVKTCSKSSIDIENGFISESQYTYALKEKAKYQCKLGYVTADGETSGSITCGKDGWSAQPTCIKSCDIPVFMNARTKNDFTWFKLNDTLDYECHDGYESNTGSTTGSIVCGYNGWSDLPICYERECELPKIDVHLVPDRKKDQYKVGEVLKFSCKPGFTIVGPNSVQCYHFGLSPDLPICKEQVQSCGPPPELLNGNVKEKTKEEYGHSEVVEYYCNPRFLMKGPNKIQCVDGEWTTLPVCIVEESTCGDIPELEHGWAQLSSPPYYYGDSVEFNCSESFTMIGHRSITCIHGVWTQLPQCVAIDKLKKCKSSNLIILEEHLKNKKEFDHNSNIRYRCRGKEGWIHTVCINGRWDPEVNCSMAQIQLCPPPPQIPNSHNMTTTLNYRDGEKVSVLCQENYLIQEGEEITCKDGRWQSIPLCVEKIPCSQPPQIEHGTINSSRSSQESYAHGTKLSYTCEGGFRISEENETTCYMGKWSSPPQCEGLPCKSPPEISHGVVAHMSDSYQYGEEVTYKCFEGFGIDGPAIAKCLGEKWSHPPSCIKTDCLSLPSFENAIPMGEKKDVYKAGEQVTYTCATYYKMDGASNVTCINSRWTGRPTCRDTSCVNPPTVQNAYIVSRQMSKYPSGERVRYQCRSPYEMFGDEEVMCLNGNWTEPPQCKDSTGKCGPPPPIDNGDITSFPLSVYAPASSVEYQCQNLYQLEGNKRITCRNGQWSEPPKCLHPCVISREIMENYNIALRWTAKQKLYSRTGESVEFVCKRGYRLSSRSHTLRTTCWDGKLEYPTCAKR

SEQ ID NO: 29 - protein, 449 aa, Homo sapiens
MRLLAKIICLMLWAICVAEDCNELPPRRNTEILTGSWSDQTYPEGTQAIYKCRPGYRSLGNVIMVCRKGEWVALNPLRKCQKRPCGHPGDTPFGTFTLTGGNVFEYGVKAVYTCNEGYQLLGEINYRECDTDGWTNDIPICEVVKCLPVTAPENGKIVSSAMEPDREYHFGQAVRFVCNSGYKIEGDEEMHCSDDGFWSKEKPKCVEISCKSPDVINGSPISQKIIYKENERFQYKCNMGYEYSERGDAVCTESGWRPLPSCEEKSCDNPYIPNGDYSPLRIKHRTGDEITYQCRNGFYPATRGNTAKCTSTGWIPAPRCTLKPCDYPDIKHGGLYHENMRRPYFPVAVGKYYSYYCDEHFETPSGSYWDHIHCTQDGWSPAVPCLRKCYFPYLENGYNQNYGRKFVQGKSIDVACHPGYALPKAQTTVTCMENGWSPTPRCIRVSFTL

SEQ ID NO: 30 - protein, 532 aa, Homo sapiens
MMMVRRGLLAWISRVVVLLVLLCCAISVLYMLACTPKGDEEQLALPRANSPTGKEGYQAVLQEWEEQHRNYVSSLKRQIAQLKEELQERSEQLRNGQYQASDAAGLGLDRSPPEKTQADLLAFLHSQVDKAEVNAGVKLATEYAAVPFDSFTLQKVYQLETGLTRHPEEKPVRKDKRDELVEAIESALETLNSPAENSPNHRPYTASDFIEGIYRTERDKGTLYELTFKGDHKHEFKRLILFRPFGPIMKVKNEKLNMANTLINVIVPLAKRVDKFRQFMQNFREMCIEQDGRVHLTVVYFGKEEINEVKGILENTSKAANFRNFTFIQLNGEFSRGKGLDVGARFWKGSNVLLFFCDVDIYFTSEFLNTCRLNTQPGKKVFYPVLFSQYNPGIIYGHHDAVPPLEQQLVIKKETGFWRDFGFGMTCQYRSDFINIGGFDLDIKGWGGEDVHLYRKYLHSNLIVVRTPVRGLFHLWHEKRCMDELTPEQYKMCMQSKAMNEASHGQLGMLVFRHEIEAHLRKQKQKTSSKKT

SEQ ID NO: 31 - protein, 275 aa, Homo sapiens
MESYSVTQAGVQWHELCSLQPSPPRFREMCIEQDGRVHLTVVYFGKEEINEVKGILENTSKAANFRNFTFIQLNGEFSRGKGLDVGARFWKGSNVLLFFCDVDIYFTSEFLNTCRLNTQPGKKVFYPVLFSQYNPGIIYGHHDAVPPLEQQLVIKKETGFWRDFGFGMTCQYRSDFINIGGFDLDIKGWGGEDVHLYRKYLHSNLIVVRTPVRGLFHLWHEKRCMDELTPEQYKMCMQSKAMNEASHGQLGMLVFRHEIEAHLRKQKQKTSSKKT

SEQ ID NO: 32 - protein, 297 aa, Homo sapiens
MMMVRRGLLAWISRVVVLLVLLCCAISVLYMLACTPKGDEEQLALPRANSPTGKEGYQAVLQEWEEQHRNYVSSLKRQIAQLKEELQERSEQLRNGQYQASDAAGLGLDRSPPEKTQADLLAFLHSQVDKAEVNAGVKLATEYAAVPFDSFTLQKVYQLETGLTRHPEEKPVRKDKRDELVEAIESALETLNSPAENSPNHRPYTASDFIEGIYRTERDKGTLYELTFKGDHKHEFKRLILFRPFGPIMKVKNEKLNMANTLINVIVPLAKRVDKFRQFMQNFRPADEVFRCVPLSP

SEQ ID NO: 33 - protein, 338 aa, Homo sapiens
MINSTSTQPPDESCSQNLLITQQIIPVLYCMVFIAGILLNGVSGWIFFYVPSSKSFIIYLKNIVIADFVMSLTFPFKILGDSGLGPWQLNVFVCRVSAVLFYVNMYVSIVFFGLISFDRYYKIVKPLWTSFIQSVSYSKLLSVIVWMLMLLLAVPNIILTNQSVREVTQIKCIELKSELGRKWHKASNYIFVAIFWIVFLLLIVFYTAITKKIFKSHLKSSRNSTSVKKKSSRNIFSIVFVFFVCFVPYHIARIPYTKSQTEAHYSCQSKEILRYMKEFTLLLSAANVCLDPIIYFFLCQPFREILCKKLHIPLKAQNDLDISRIKRGNTTLESTDTL

SEQ ID NO: 34 - protein, 673 aa, Homo sapiens
MDLTKMGMIQLQNPSHPTGLLCKANQMRLAGTLCDVVIMVDSQEFHAHRTVLACTSKMFEILFHRNSQHYTLDFLSPKTFQQILEYAYTATLQAKAEDLDDLLYAAEILEIEYLEEQCLKMLETIQASDDNDTEATMADGGAEEEEDRKARYLKNIFISKHSSEESGYASVAGQSLPGPMVDQSPSVSTSFGLSAMSPTKAAVDSLMTIGQSLLQGTLQPPAGPEEPTLAGGGRHPGVAEVKTEMMQVDEVPSQDSPGAAESSISGGMGDKVEERGKEGPGTPTRSSVITSARELHYGREESAEQVPPPAEAGQAPTGRPEHPAPPPEKHLGIYSVLPNHKADAVLSMPSSVTSGLHVQPALAVSMDFSTYGGLLPQGFIQRELFSKLGELAVGMKSESRTIGEQCSVCGVELPDNEAVEQHRKLHSGMKTYGCELCGKRFLDSLRLRMHLLAHSAGAKAFVCDQCGAQFSKEDALETHRQTHTGTDMAVFCLLCGKRFQAQSALQQHMEVHAGVRSYICSECNRTFPSHTALKRHLRSHTGDHPYECEFCGSCFRDESTLKSHKRIHTGEKPYECNGCGKKFSLKHQLETHYRVHTGEKPFECKLCHQRSRDYSAMIKHLRTHNGASPYQCTICTEYCPSLSSMQKHMKGHKPEEIPPDWRIEKTYLYLCYV

SEQ ID NO: 35 - protein, 550 aa, Homo sapiens
MDLTKMGMIQLQNPSHPTGLLCKANQMRLAGTLCDVVIMVDSQEFHAHRTVLACTSKMFEILFHRNSQHYTLDFLSPKTFQQILEYAYTATLQAKAEDLDDLLYAAEILEIEYLEEQCLKMLETIQASDDNDTEATMADGGAEEEEDRKARYLKNIFISKHSSEESGYASVAGQSLPGPMVDQSPSVSTSFGLSAMSPTKAAVDSLMTIGQSLLQGTLQPPAGPEEPTLAGGGRHPGVAEVKTEMMQVDEVPSQGFIQRELFSKLGELAVGMKSESRTIGEQCSVCGVELPDNEAVEQHRKLHSGMKTYGCELCGKRFLDSLRLRMHLLAHSAGAKAFVCDQCGAQFSKEDALETHRQTHTGTDMAVFCLLCGKRFQAQSALQQHMEVHAGVRSYICSECNRTFPSHTALKRHLRSHTGDHPYECEFCGSCFRDESTLKSHKRIHTGEKPYECNGCGKKFSLKHQLETHYRVHTGEKPFECKLCHQRSRDYSAMIKHLRTHNGASPYQCTICTEYCPSLSSMQKHMKGHKPEEIPPDWRIEKTYLYLCYV

SEQ ID NO: 36 - protein, 310 aa, Homo sapiens
MGILSFLPVLATESDWADCKSPQPWGHMLLWTAVLFLAPVAGTPAAPPKAVLKLEPQWINVLQEDSVTLTCRGTHSPESDSIQWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLYSSKPVTITVQAPSSSPMGIIVAVVTGIAVAAIVAAVVALIYCRKKRISALPGYPECREMGETLPEKPANPTNPDEADKVGAENTITYSLLMHPDALEEPDDQNRI

SEQ ID NO: 37 - protein, 291 aa, Homo sapiens
MGILSFLPVLATESDWADCKSPQPWGHMLLWTAVLFLAPVAGTPAAPPKAVLKLEPQWINVLQEDSVTLTCRGTHSPESDSIQWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLYSSKPVTITVQAPSSSPMGIIVAVVTGIAVAAIVAAVVALIYCRKKRISANPTNPDEADKVGAENTITYSLLMHPDALEEPDDQNRI

SEQ ID NO: 38 - protein, 303 aa, Homo sapiens
MGILSFLPVLATESDWADCKSPQPWGHMLLWTAVLFLAAPPKAVLKLEPQWINVLQEDSVTLTCRGTHSPESDSIQWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLYSSKPVTITVQAPSSSPMGIIVAVVTGIAVAAIVAAVVALIYCRKKRISALPGYPECREMGETLPEKPANPTNPDEADKVGAENTITYSLLMHPDALEEPDDQNRI

SEQ ID NO: 39 - protein, 543 aa, Homo sapiens
MGTSLSPNDPWPLNPLSIQQTTLLLLLSVLATVHVGQRLLRQRRRQLRSAPPGPFAWPLIGNAAAVGQAAHLSFARLARRYGDVFQIRLGSCPIVVLNGERAIHQALVQQGSAFADRPAFASFRVVSGGRSMAFGHYSEHWKVQRRAAHSMMRNFFTRQPRSRQVLEGHVLSEARELVALLVRGSADGAFLDPRPLTVVAVANVMSAVCFGCRYSHDDPEFRELLSHNEEFGRTVGAGSLVDVMPWLQYFPNPVRTVFREFEQLNRNFSNFILDKFLRHCESLRPGAAPRDMMDAFILSAEKKAAGDSHGGGARLDLENVPATITDIFGASQDTLSTALQWLLLLFTRYPDVQTRVQAELDQVVGRDRLPCMGDQPNLPYVLAFLYEAMRFSSFVPVTIPHATTANTSVLGYHIPKDTVVFVNQWSVNHDPLKWPNPENFDPARFLDKDGLINKDLTSRVMIFSVGKRRCIGEELSKMQLFLFISILAHQCDFRANPNEPAKMNFSYGLTIKPKSFKVNVTLRESMELLDSAVQNLQAKETCQ

SEQ ID NO: 40 - protein, 1025 aa, Homo sapiens
MAPVLSKDSADIESILALNPRTQTHATLCSTSAKKLDKKHWKRNPDKNCFNCEKLENNFDDIKHTTLGERGALREAMRCLKCADAPCQKSCPTNLDIKSFITSIANKNYYGAAKMIFSDNPLGLTCGMVCPTSDLCVGGCNLYATEEGPINIGGLQQFATEVFKAMSIPQIRNPSLPPPEKMSEAYSAKIALFGAGPASISCASFLARLGYSDITIFEKQEYVGGLSTSEIPQFRLPYDVVNFEIELMKDLGVKIICGKSLSVNEMTLSTLKEKGYKAAFIGIGLPEPNKDAIFQGLTQDQGFYTSKDFLPLVAKGSKAGMCACHSPLPSIRGVVIVLGAGDTAFDCATSALRCGARRVFIVFRKGFVNIRAVPEEMELAKEEKCEFLPFLSPRKVIVKGGRIVAMQFVRTEQDETGKWNEDEDQMVHLKADVVISAFGSVLSDPKVKEALSPIKFNRWGLPEVDPETMQTSEAWVFAGGDVVGLANTTVESVNDGKQASWYIHKYVQSQYGASVSAKPELPLFYTPIDLVDISVEMAGLKFINPFGLASATPATSTSMIRRAFEAGWGFALTKTFSLDKDIVTNVSPRIIRGTTSGPMYGPGQSSFLNIELISEKTAAYWCQSVTELKADFPDNIVIASIMCSYNKNDWTELAKKSEDSGADALELNLSCPHGMGERGMGLACGQDPELVRNICRWVRQAVQIPFFAKLTPNVTDIVSIARAAKEGGANGVTATNTVSGLMGLKSDGTPWPAVGIAKRTTYGGVSGTAIRPIALRAVTSIARALPGFPILATGGIDSAESGLQFLHSGASVLQVCSAIQNQDFTVIEDYCTGLKALLYLKSIEELQDWDGQSPATVSHQKGKPVPRIAELMDKKLPSFGPYLEQRKKIIAENKIRLKEQNVAFSPLKRNCFIPKRPIPTIKDVIGKALQYLGTFGELSNVEQVVAMIDEEMCINCGKCYMTCNDSGYQAIQFDPETHLPTITDTCTGCTLCLSVCPIVDCIKMVSRTTPYEPKRGVPLSVNPVC

SEQ ID NO: 41 - protein, 173 aa, Homo sapiens
MAPVLSKDSADIESILALNPRTQTHATLCSTSAKKLDKKHWKRNPDKNCFNCEKLENNFDDIKHTTLGERGALREAMRCLKCADAPCQKSCPTNLDIKSFITSIANKNYYGAAKMIFSDNPLGLTCGMVCPTSDLCVGGCNLYATEEGPINIGGLQQFATETLILAFSLMNHL

SEQ ID NO: 42 - protein, 637 aa, Homo sapiens
MGLLSQGSPLSWEETKRHADHVRRHGILQFLHIYHAVKDRHKDVLKWGDEVEYMLVSFDHENKKVRLVLSGEKVLETLQEKGERTNPNHPTLWRPEYGSYMIEGTPGQPYGGTMSEFNTVEANMRKRRKEATSILEENQALCTITSFPRLGCPGFTLPEVKPNPVEGGASKSLFFPDEAINKHPRFSTLTRNIRHRRGEKVVINVPIFKDKNTPSPFIETFTEDDEASRASKPDHIYMDAMGFGMGNCCLQVTFQACSISEARYLYDQLATICPIVMALSAASPFYRGYVSDIDCRWGVISASVDDRTREERGLEPLKNNNYRISKSRYDSIDSYLSKCGEKYNDIDLTIDKEIYEQLLQEGIDHLLAQHVAHLFIRDPLTLFEEKIHLDDANESDHFENIQSTNWQTMRFKPPPPNSDIGWRVEFRPMEVQLTDFENSAYVVFVVLLTRVILSYKLDFLIPLSKVDENMKVAQKRDAVLQGMFYFRKDICKGGNAVVDGCGKAQNSTELAAEEYTLMSIDTIINGKEGVFPGLIPILNSYLENMEVDVDTRCSILNYLKLIKKRASGELMTVARWMREFIANHPDYKQDSVITDEMNYSLILKCNQIANELCECPELLGSAFRKVKYSGSKTDSSN

SEQ ID NO: 43 - protein, 642 aa, Homo sapiens
MIPNGYLMFEDENFIESSVAKLNALRKSGQFCDVRLQVCGHEMLAHRAVLACCSPYLFEIFNSDSDPHGISHVKFDDLNPEAVEVLLNYAYTAQLKADKELVKDVYSAAKKLKMDRVKQVCGDYLLSRMDVTSCISYRNFASCMGDSRLLNKVDAYIQEHLLQISEEEEFLKLPRLKLEVMLEDNVCLPSNGKLYTKVINWVQRSIWENGDSLEELMEEVQTLYYSADHKLLDGNLLDGQAEVFGSDDDHIQFVQKKPPRENGHKQISSSSTGCLSSPNATVQSPKHEWKIVASEKTSNNTYLCLAVLDGIFCVIFLHGRNSPQSSPTSTPKLSKSLSFEMQQDELIEKPMSPMQYARSGLGTAEMNGKLIAAGGYNREECLRTVECYNPHTDHWSFLAPMRTPRARFQMAVLMGQLYVVGGSNGHSDDLSCGEMYDSNIDDWIPVPELRTNRCNAGVCALNGKLYIVGGSDPYGQKGLKNCDVFDPVTKLWTSCAPLNIRRHQSAVCELGGYLYIIGGAESWNCLNTVERYNPENNTWTLIAPMNVARRGAGVAVLNGKLFVCGGFDGSHAISCVEMYDPTRNEWKMMGNMTSPRSNAGIATVGNTIYAVGGFDGNEFLNTVEVYNLESNEWSPYTKIFQF

SEQ ID NO: 44 - protein, 305 aa, Homo sapiens
MGGTLAWTLLLPLLLRESDSLEPSCTVSSADVDWNAEFSATCLNFSGLSLSLPHNQSLRASNVILLDLSGNGLRELPVTFFAHLQKLEVLNVLRNPLSRVDGALAARCDLDLQADCNCALESWHDIRRDNCSGQKPLLCWDTTSSQHNLSAFLEVSCAPGLASATIGAVVVSGCLLLGLAIAGPVLAWRLWRCRVARSRELNKPWAAQDGPKPGLGLQPRYGSRSAPKPQVAVPSCPSTPDYENMFVGQPAAEHQWDEQGAHPSEDNDFYINYKDIDLASQPVYCNLQSLGQAPMDEEEYVIPGH

SEQ ID NO: 45 - protein, 195 aa, Homo sapiens
MAGARRLELGEALALGSGWRHACHALLYAPDPGMLFGRIPLRYAILMQMRFDGRLGFPGGFVDTQDRSLEDGLNRELREELGEAAAAFRVERTDYRSSHVGSGPRVVAHFYAKRLTLEELLAVEAGATRAKDHGLEVLGLVRVPLYTLRDGVGGLPTFLENSFIGSAREQLLEALQDLGLLQSGSISGLKIPAHH

SEQ ID NO: 46 - protein, 194 aa, Homo sapiens
MLFGRIPLRYAILMQMRFDGRLGFPGGFVDTQDRSLEDGLNRELREELGEAAAAFRVERTDYRSSHVGSGPRVVAHFYAKRLTLEELLAVEAGATRAKDHGLEVGPAWDSVPFPISSSPKAFSPPRKHPWRKVFAPLTLPSPQLSWWSWDRDHLYSELVLPTWAFCKGLSHPLPGEILSRTHSSMSLCCSLLTV

SEQ ID NO: 47 - protein, 159 aa, Homo sapiens
MQMRFDGRLGFPGGFVDTQDRSLEDGLNRELREELGEAAAAFRVERTDYRSSHVGSGPRVVAHFYAKRLTLEELLAVEAGATRAKDHGLEVLGLVRVPLYTLRDGVGGLPTFLENSFIGSAREQLLEAALHGPMKTEMRTLVLGREGRTWECFLIGSER

SEQ ID NO: 48 - protein, 227 aa, Homo sapiens
MAGARRLELGEALALGSGWRHACHALLYAPDPGMLFGRIPLRYAILMQMRFDGRLGFPGGFVDTQDRSLEDGLNRELREELGEAAAAFRVERTDYRSSHVGSGPRVVAHFYAKRLTLEELLAVEAGATRAKDHGLEVGPAWDSVPFPISSSPKAFSPPRKHPWRKVFAPLTLPSPQLSWWSWDRDHLYSELVLPTWAFCKGLSHPLPGEILSRTHSSMSLCCSLLTV

SEQ ID NO: 49 - protein, 469 aa, Homo sapiens
MDVENEQILNVNPADPDNLSDSLFSGDEENAGTEEIKNEINGNWISASSINEARINAKAKRRLRKNSSRDSGRGDSVSDSGSDALRSGLTVPTSPKGRLLDRRSRSGKGRGLPKKGGAGGKGVWGTPGQVYDVEEVDVKDPNYDDDQENCVYETVVLPLDERAFEKTLTPIIQEYFEHGDTNEVAEMLRDLNLGEMKSGVPVLAVSLALEGKASHREMTSKLLSDLCGTVMSTTDVEKSFDKLLKDLPELALDTPRAPQLVGQFIARAVGDGILCNTYIDSYKGTVDCVQARAALDKATVLLSMSKGGKRKDSVWGSGGGQQSVNHLVKEIDMLLKEYLLSGDISEAEHCLKELEVPHFHHELVYEAIIMVLESTGESTFKMILDLLKSLWKSSTITVDQMKRGYERIYNEIPDINLDVPHSYSVLERFVEECFQAGIISKQLRDLCPSRGRKRFVSEGDGGRLKPESY

SEQ ID NO: 50 - protein, 458 aa, Homo sapiens
MTKYPDNLSDSLFSGDEENAGTEEIKNEINGNWISASSINEARINAKAKRRLRKNSSRDSGRGDSVSDSGSDALRSGLTVPTSPKGRLLDRRSRSGKGRGLPKKGGAGGKGVWGTPGQVYDVEEVDVKDPNYDDDQENCVYETVVLPLDERAFEKTLTPIIQEYFEHGDTNEVAEMLRDLNLGEMKSGVPVLAVSLALEGKASHREMTSKLLSDLCGTVMSTTDVEKSFDKLLKDLPELALDTPRAPQLVGQFIARAVGDGILCNTYIDSYKGTVDCVQARAALDKATVLLSMSKGGKRKDSVWGSGGGQQSVNHLVKEIDMLLKEYLLSGDISEAEHCLKELEVPHFHHELVYEAIIMVLESTGESTFKMILDLLKSLWKSSTITVDQMKRGYERIYNEIPDINLDVPHSYSVLERFVEECFQAGIISKQLRDLCPSRGRKRFVSEGDGGRLKPESY

SEQ ID NO: 51 - protein, 150 aa, Homo sapiens
MVLCFPLLLLLLVLWGPVCPLHAWPKRLTKAHWFEIQHIQPSPLQCNRAMSGINNYTQHCKHQNTFLHDSFQNVAAVCDLLSIVCKNRRHNCHQSSKPVNMTDCRLTSGKYPQCRYSAAAQYKFFIVACDPPQKSDPPYKLVPVHLDSIL

SEQ ID NO: 52 - protein, 256 aa, Homo sapiens
MRPAALRGALLGCLCLALLCLGGADKRLRDNHEWKKLIMVQHWPETVCEKIQNDCRDPPDYWTIHGLWPDKSEGCNRSWPFNLEEIKDLLPEMRAYWPDVIHSFPNRSRFWKHEWEKHGTCAAQVDALNSQKKYFGRSLELYRELDLNSVLLKLGIKPSINYYQVADFKDALARVYGVIPKIQCLPPSQDEEVQTIGQIELCLTKQDQQLQNCTEPGEQPSPKQEVWLANGAAESRGLRVCEDGPVFYPPPKKTKH

SEQ ID NO: 53 - protein, 121 aa, Homo sapiens
MRPAALRGALLGCLCLALLCLGGADKRLRDNHEWKKLIMVQHWPETVCEKIQNDCRDPPDYWTIHGLWPDKSEGCNRSWPFNLEEIKKNWMEITDSSLPSPSTLPIINIFYSVLHLLQLMN

SEQ ID NO: 54 - protein, 254 aa, Homo sapiens
MWQLLLPTALLLLVSAGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLFGSKNVSSETVNITITQGLAVSTISSFFPPGYQVSFCLVMVLLFAVDTGLYFSVKTNIRSSTRDWKDHKFKWRKDPQDK

SEQ ID NO: 55 - protein, 245 aa, Homo sapiens
MEGPRGWLVLCVLAISLASMVTEDLCRAPDGKKGEAGRPGRRGRPGLKGEQGEPGAPGIRTGIQGLKGDQGEPGPSGNPGKVGYPGPSGPLGARGIPGIKGTKGSPGNIKDQPRPAFSAIRRNPPMGGNVVIFDTVITNQEEPYQNHSGRFVCTVPGYYYFTFQVLSQWEICLSIVSSSRGQVRRSLGFCDTTNKGLFQVVSGGMVLQLQQGDQVWVEKDPKKGHIYQGSEADSVFSGFLIFPSA

SEQ ID NO: 56 - protein, 86 aa, Homo sapiens
MIPAVVLLLLLLVEQAAALGEPQLCYILDAILFLYGIVLTLLYCRLKIQVRKAAITSYEKSDGVYTGLSTRNQETYETLKHEKPPQ

SEQ ID NO: 57 - protein, 999 aa, Homo sapiens
MEPRAAAAGEPEPPAASSSFQARLWKNLQLGVGRSKGGGGGRAGGPERRTADTPSPSPPPPVGTGNAPARGSGAGSRWSGFKKRKQVLDRVFSSSQPNLCCSSPEPLEPGGAGRAEQGSTLRRRIREHLLPAVKGPAAASGAAGGTPPGGRSPDSAPSSSSASSSLSSSPQPPPRGDRARDEGARRQGPGAHLCHQKSSSLPGTACLEQLLEPPPPPAEPARSPAESRAPETGEEHGSSQKIINTAGTSNAEVPLADPGMYQLDITLRRGQSLAARDRGGTSDPYVKFKIGGKEVFRSKIIHKNLNPVWEEKACILVDHLREPLYIKVFDYDFGLQDDFMGSAFLDLTQLELNRPTDVTLTLKDPHYPDHDLGIILLSVILTPKEGESRDVTMLMRKSWKRSSKELSENEVVGSYFSVKSLFWRTCGRPALPVLGFCRAELQNPYCKNVQFQTQSLRLSDLHRKSHLWRGIVSITLIEGRDLKAMDSNGLSDPYVKFRLGHQKYKSKIMPKTLNPQWREQFDFHLYEERGGVIDITAWDKDAGKRDDFIGRCQVDLSALSREQTHKLELQLEEGEGHLVLLVTLTASATVSISDLSVNSLEDQKEREEILKRYSPLRIFHNLKDVGFLQVKVIRAEGLMAADVTGKSDPFCVVELNNDRLLTHTVYKNLNPEWNKVFTFNIKDIHSVLEVTVYDEDRDRSADFLGKVAIPLLSIQNGEQKAYVLKNKQLTGPTKGVIYLEIDVIFNAVKASLRTLIPKEQKYIEEENRLSKQLLLRNFIRMKRCVMVLVNAAYYVNSCFDWDSPPRSLAAFVLFLFVVWNFELYMIPLVLLLLLTWNYFLIISGKDNRQRDTVVEDMLEDEEEEDDKDDKDSEKKGFINKIYAIQEVCVSVQNILDEVASFGERIKNTFNWTVPFLSWLAIVALCVFTAILYCIPLRYIVLVWGINKFTKKLRSPYAIDNNELLDFLSRVPSDVQVVQYQELKPDPSHSPYKRKKNNLG

SEQ ID NO: 58 - protein, 778 aa, Homo sapiens
MLDSCKLKSACNLPFICNKKIINTAGTSNAEVPLADPGMYQLDITLRRGQSLAARDRGGTSDPYVKFKIGGKEVFRSKIIHKNLNPVWEEKACILVDHLREPLYIKVFDYDFGLQDDFMGSAFLDLTQLELNRPTDVTLTLKDPHYPDHDLGIILLSVILTPKEGESRDVTMLMRKSWKRSSKELSENEVVGSYFSVKSLFWRTCGRPALPVLGFCRAELQNPYCKNVQFQTQSLRLSDLHRKSHLWRGIVSITLIEGRDLKAMDSNGLSDPYVKFRLGHQKYKSKIMPKTLNPQWREQFDFHLYEERGGVIDITAWDKDAGKRDDFIGRCQVDLSALSREQTHKLELQLEEGEGHLVLLVTLTASATVSISDLSVNSLEDQKEREEILKRYSPLRIFHNLKDVGFLQVKVIRAEGLMAADVTGKSDPFCVVELNNDRLLTHTVYKNLNPEWNKVFTFNIKDIHSVLEVTVYDEDRDRSADFLGKVAIPLLSIQNGEQKAYVLKNKQLTGPTKGVIYLEIDVIFNAVKASLRTLIPKEQKYIEEENRLSKQLLLRNFIRMKRCVMVLVNAAYYVNSCFDWDSPPRSLAAFVLFLFVVWNFELYMIPLVLLLLLTWNYFLIISGKDNRQRDTVVEDMLEDEEEEDDKDDKDSEKKGFINKIYAIQEVCVSVQNILDEVASFGERIKNTFNWTVPFLSWLAIVALCVFTAILYCIPLRYIVLVWGINKFTKKLRSPYAIDNNELLDFLSRVPSDVQVVQYQELKPDPSHSPYKRKKNNLG

SEQ ID NO: 59 - protein, 692 aa, Homo sapiens
MLDSCKLKSACNLPFICNKKIINTAGTSNAEVPLADPGMYQLDITLRRGQSLAARDRGGTSDPYVKFKIGGKEVFRSKIIHKNLNPVWEEKACILVDHLREPLYIKVFDYDFGLQDDFMGSAFLDLTQLELNRPTDVTLTLKDPHYPDHDLGIILLSVILTPKEGESRDVTMLMRKSWKRSSKFQTQSLRLSDLHRKSHLWRGIVSITLIEGRDLKAMDSNGLSDPYVKFRLGHQKYKSKIMPKTLNPQWREQFDFHLYEERGGVIDITAWDKDAGKRDDFIGRCQVDLSALSREQTHKLELQLEEGEGHLVLLVTLTASATVSISDLSVNSLEDQKEREEILKRYSPLRIFHNLKDVGFLQVKVIRAEGLMAADVTGKSDPFCVVELNNDRLLTHTVYKNLNPEWNKVFTFNIKDIHSVLEVTVYDEDRDRSADFLGKVAIPLLSIQNGEQKAYVLKNKQLTGPTKGVIYLEIDVIFNAVKASLRTLIPKEQKYIEEENRLSKQLLLRNFIRMKRCVMVLVNAAYYVNSCFDWDSPPRSLAAFVVVEDMLEDEEEEDDKDDKDSEKKGFINKIYAIQEVCVSVQNILDEVASFGERIKNTFNWTVPFLSWLAIVALCVFTAILYCIPLRYIVLVWGINKFTKKLRSPYAIDNNELLDFLSRVPSDVQVVQYQELKPDPSHSPYKRKKNNLG

SEQ ID NO: 60 - protein, 600 aa, Homo sapiens
MLDSCKLKSACNLPFICNKKIINTAGTSNAEVPLADPGMYQLDITLRRGQSLAARDRGGTSDPYVKFKIGGKEVFRSKIIHKNLNPVWEEKACILVDHLREPLYIKVFDYDFGLQDDFMGSAFLDLTQLELNRPTDVTLTLKDPHYPDHDLGIILLSVILTPKEGESRDVTMLMRKSWKRSSKELSENEVVGSYFSVKSLFWRTCGRPALPVLGFCRAELQNPYCKNVQFQTQSLRLSDLHRKSHLWRGIVSITLIEGRDLKAMDSNGLSDPYVKFRLGHQKYKSKIMPKTLNPQWREQFDFHLYEERGGVIDITAWDKDAGKRDDFIGRCQVDLSALSREQTHKLELQLEEGEGHLVLLVTLTASATVSISDLSVNSLEDQKEREEILKRYSPLRIFHNLKDVGFLQVKVIRAEGLMAADVTGKSDPFCVVELNNDRLLTHTVYKNLNPEWNKVFTFNIKDIHSVLEVTVYDEDRDRSADFLGKVAIPLLSIQNGEQKAYVLKNKQLTGPTKGVIYLEIDVIFNAVKASLRTLIPKEQKYIEEENRLSKQLLLRNFIRMKRCVMVLVNAAYYVNSCFDWDSPPRSLAAFVALYGTFINV

SEQ ID NO: 61 - protein, 515 aa, Homo sapiens
MDSNGLSDPYVKFRLGHQKYKSKIMPKTLNPQWREQFDFHLYEERGGVIDITAWDKDAGKRDDFIGRCQVDLSALSREQTHKLELQLEEGEGHLVLLVTLTASATVSISDLSVNSLEDQKEREEILKRYSPLRIFHNLKDVGFLQVKVIRAEGLMAADVTGKSDPFCVVELNNDRLLTHTVYKNLNPEWNKVFTFNIKDIHSVLEVTVYDEDRDRSADFLGKVAIPLLSIQNGEQKAYVLKNKQLTGPTKGVIYLEIDVIFNAVKASLRTLIPKEQKYIEEENRLSKQLLLRNFIRMKRCVMVLVNAAYYVNSCFDWDSPPRSLAAFVLFLFVVWNFELYMIPLVLLLLLTWNYFLIISGKDNRQRDTVVEDMLEDEEEEDDKDDKDSEKKGFINKIYAIQEVCVSVQNILDEVASFGERIKNTFNWTVPFLSWLAIVALCVFTAILYCIPLRYIVLVWGINKFTKKLRSPYAIDNNELLDFLSRVPSDVQVVQYQELKPDPSHSPYKRKKNNLG

SEQ ID NO: 62 - protein, 551 aa, Homo sapiens
MLPLLLLPLLWGGSLQEKPVYELQVQKSVTVQEGLCVLVPCSFSYPWRSWYSSPPLYVYWFRDGEIPYYAEVVATNNPDRRVKPETQGRFRLLGDVQKKNCSLSIGDARMEDTGSYFFRVERGRDVKYSYQQNKLNLEVTALIEKPDIHFLEPLESGRPTRLSCSLPGSCEAGPPLTFSWTGNALSPLDPETTRSSELTLTPRPEDHGTNLTCQMKRQGAQVTTERTVQLNVSYAPQTITIFRNGIALEILQNTSYLPVLEGQALRLLCDAPSNPPAHLSWFQGSPALNATPISNTGILELRRVRSAEEGGFTCRAQHPLGFLQIFLNLSVYSLPQLLGPSCSWEAEGLHCRCSFRARPAPSLCWRLEEKPLEGNSSQGSFKVNSSSAGPWANSSLILHGGLSSDLKVSCKAWNIYGSQSGSVLLLQGRSNLGTGVVPAALGGAGVMALLCICLCLIFFLIVKARRKQAAGRPEKMDDEDPIMGTITSGSRKKPWPDSPGDQASPPGDAPPLEEQKELHYASLSFSEMKSREPKDQEAPSTTEYSEIKTSK

SEQ ID NO: 63 - protein, 443 aa, Homo sapiens
MEVTADQPRWVSHHHPAVLNGQHPDTHHPGLSHSYMDAAQYPLPEEVDVLFNIDGQGNHVPPYYGNSVRATVQRYPPTHHGSQVCRPPLLHGSLPWLDGGKALGSHHTASPWNLSPFSKTSIHHGSPGPLSVYPPASSSSLSGGHASPHLFTFPPTPPKDVSPDPSLSTPGSAGSARQDEKECLKYQVPLPDSMKLESSHSRGSMTALGGASSSTHHPITTYPPYVPEYSSGLFPPSSLLGGSPTGFGCKSRPKARSSTGRECVNCGATSTPLWRRDGTGHYLCNACGLYHKMNGQNRPLIKPKRRLSAARRAGTSCANCQTTTTTLWRRNANGDPVCNACGLYYKLHNINRPLTMKKEGIQTRNRKMSSKSKKCKKVHDSLEDFPKNSSFNPAALSRHMSSLSHISPFSHSSHMLTTPTPMHPPSSLSFGPHHPSSMVTAMG

SEQ ID NO: 64 - protein, 444 aa, Homo sapiens
MEVTADQPRWVSHHHPAVLNGQHPDTHHPGLSHSYMDAAQYPLPEEVDVLFNIDGQGNHVPPYYGNSVRATVQRYPPTHHGSQVCRPPLLHGSLPWLDGGKALGSHHTASPWNLSPFSKTSIHHGSPGPLSVYPPASSSSLSGGHASPHLFTFPPTPPKDVSPDPSLSTPGSAGSARQDEKECLKYQVPLPDSMKLESSHSRGSMTALGGASSSTHHPITTYPPYVPEYSSGLFPPSSLLGGSPTGFGCKSRPKARSSTEGRECVNCGATSTPLWRRDGTGHYLCNACGLYHKMNGQNRPLIKPKRRLSAARRAGTSCANCQTTTTTLWRRNANGDPVCNACGLYYKLHNINRPLTMKKEGIQTRNRKMSSKSKKCKKVHDSLEDFPKNSSFNPAALSRHMSSLSHISPFSHSSHMLTTPTPMHPPSSLSFGPHHPSSMVTAMG

SEQ ID NO: 65 - protein, 832 aa, Homo sapiens
MEGDGGTPWALALLRTFDAGEFTGWEKVGSGGFGQVYKVRHVHWKTWLAIKCSPSLHVDDRERMELLEEAKKMEMAKFRYILPVYGICREPVGLVMEYMETGSLEKLLASEPLPWDLRFRIIHETAVGMNFLHCMAPPLLHLDLKPANILLDAHYHVKISDFGLAKCNGLSHSHDLSMDGLFGTIAYLPPERIREKSRLFDTKHDVYSFAIVIWGVLTQKKPFADEKNILHIMVKVVKGHRPELPPVCRARPRACSHLIRLMQRCWQGDPRVRPTFQGNGLNGELIRQVLAALLPVTGRWRSPGEGFRLESEVIIRVTCPLSSPQEITSETEDLCEKPDDEVKETAHDLDVKSPPEPRSEVVPARLKRASAPTFDNDYSLSELLSQLDSGVSQAVEGPEELSRSSSESKLPSSGSGKRLSGVSSVDSAFSSRGSLSLSFEREPSTSDLGTTDVQKKKLVDAIVSGDTSKLMKILQPQDVDLALDSGASLLHLAVEAGQEECAKWLLLNNANPNLSNRRGSTPLHMAVERRVRGVVELLLARKISVNAKDEDQWTALHFAAQNGDESSTRLLLEKNASVNEVDFEGRTPMHVACQHGQENIVRILLRRGVDVSLQGKDAWLPLHYAAWQGHLPIVKLLAKQPGVSVNAQTLDGRTPLHLAAQRGHYRVARILIDLCSDVNVCSLLAQTPLHVAAETGHTSTARLLLHRGAGKEAMTSDGYTALHLAARNGHLATVKLLVEEKADVLARGPLNQTALHLAAAHGHSEVVEELVSADVIDLFDEQGLSALHLAAQGRHAQTVETLLRHGAHINLQSLKFQGGHGPAATLLRRSKT

SEQ ID NO: 66 - protein, 784 aa, Homo sapiens
MEGDGGTPWALALLRTFDAGEFTGWEKVGSGGFGQVYKVRHVHWKTWLAIKCSPSLHVDDRERMELLEEAKKMEMAKFRYILPVYGICREPVGLVMEYMETGSLEKLLASEPLPWDLRFRIIHETAVGMNFLHCMAPPLLHLDLKPANILLDAHYHVKISDFGLAKCNGLSHSHDLSMDGLFGTIAYLPPERIREKSRLFDTKHDVYSFAIVIWGVLTQKKPFADEKNILHIMVKVVKGHRPELPPVCRARPRACSHLIRLMQRCWQGDPRVRPTFQEITSETEDLCEKPDDEVKETAHDLDVKSPPEPRSEVVPARLKRASAPTFDNDYSLSELLSQLDSGVSQAVEGPEELSRSSSESKLPSSGSGKRLSGVSSVDSAFSSRGSLSLSFEREPSTSDLGTTDVQKKKLVDAIVSGDTSKLMKILQPQDVDLALDSGASLLHLAVEAGQEECAKWLLLNNANPNLSNRRGSTPLHMAVERRVRGVVELLLARKISVNAKDEDQWTALHFAAQNGDESSTRLLLEKNASVNEVDFEGRTPMHVACQHGQENIVRILLRRGVDVSLQGKDAWLPLHYAAWQGHLPIVKLLAKQPGVSVNAQTLDGRTPLHLAAQRGHYRVARILIDLCSDVNVCSLLAQTPLHVAAETGHTSTARLLLHRGAGKEAMTSDGYTALHLAARNGHLATVKLLVEEKADVLARGPLNQTALHLAAAHGHSEVVEELVSADVIDLFDEQGLSALHLAAQGRHAQTVETLLRHGAHINLQSLKFQGGHGPAATLLRRSKT

SEQ ID NO: 67 - protein, 128 aa, Homo sapiens
MGFQKFSPFLALSILVLLQAGSLHAAPFRSALESSPADPATLSEDEARLLLAALVQNYVQMKASELEQEQEREGSRIIAQKRACDTATCVTHRLAGLLSRSGGVVKNNFVPTNVGSKAFGRRRRDLQA

SEQ ID NO: 68 - protein, 361 aa, Homo sapiens
MSKCARKKYIKTNPRQMTMETVESQHDGSITASLTESKSAHVQTQTGQNSIPALAQVSVAGSGTRRGSPAVTLVQLPSGQTIHVQGVIQTPQPWVIQSSEIHTVQVAAIAETDESAESEGVIDSHKRREILSRRPSYRKILNELSSDVPGVPKIEEERSEEEGTPPSIATMAVPTSIYQTSTGQYIAIAQGGTIQISNPGSDGVQGLQALTMTNSGAPPPGATIVQYAAQSADGTQQFFVPGSQVVVQDEETELAPSHMAAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 69 - protein, 349 aa, Homo sapiens
MSKCARKKYIKTNPRQMTMETVESQHDGSITASLTESKSAHVQTQTGQNSIPALAQVSVAGSGTRRGSPAVTLVQLPSGQTIHVQGVIQTPQPWVIQSSEIHTVQVAAIAETDESAESEGVIDSHKRREILSRRPSYRKILNELSSDVPGVPKIEEERSEEEGTPPSIATMAVPTSIYQTSTGQYIAIAQGGTIQISNPGSDGVQGLQALTMTNSGAPPPGATIVQYAAQSADGTQQFFVPGSQVVVQAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 70 - protein, 348 aa, Homo sapiens
MSKCARKKYIKTNPRQMTMETVESQHDGSITASLTESKSAHVQTQTGQNSIPALAQVSVAGSGTRRGSPAVTLVQLPSGQTIHVQGVIQTPQPWVIQSSEIHTVQVAAIAETDESAESEGVIDSHKRREILSRRPSYRKILNELSSDVPGVPKIEEERSEEEGTPPSIATMAVPTSIYQTSTGQYIAIAQGGTIQISNPGSDGVQGLQALTMTNSGAPPPGATIVQYAAQSADGTQQFFVPGSQVVVQAATGDMPTYQIRAPTAALPQGVVMAASPGSLHSPQQLAEEATRKRELRLMKNREAARECRRKKKEYVKCLENRVAVLENQNKTLIEELKALKDLYCHKVE

SEQ ID NO: 71 - protein, 237 aa, Homo sapiens
MSKCARKKYIKTNPRQMTMETVESQHDGSITASLTESKSAHVQTQTGQNSIPALAQVAAIAETDESAESEGVIDSHKRREILSRRPSYRKILNELSSDVPGVPKIEEERSEEEGTPPSIATMAVPTSIYQTSTGQYTATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 72 - protein, 245 aa, Homo sapiens
MVAAIAETDESAESEGVIDSHKRREILSRRPSYRKILNELSSDVPGVPKIEEERSEEEGTPPSIATMAVPTSIYQTSTGQYIAIAQGGTIQISNPGSDGVQGLQALTMTNSGAPPPGATIVQYAAQSADGTQQFFVPGSQVVVQAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 73 - protein, 120 aa, Homo sapiens
MAVTGDDTDEETELAPSHMAAATGDMPTYQIRAPTAALPQGVVMAASPGSLHSPQQLAEEATRKRELRLMKNREAARECRRKKKEYVKCLENRVAVLENQNKTLIEELKALKDLYCHKVE

SEQ ID NO: 74 - protein, 108 aa, Homo sapiens
MAVTGDDTAATGDMPTYQIRAPTAALPQGVVMAASPGSLHSPQQLAEEATRKRELRLMKNREAARECRRKKKEYVKCLENRVAVLENQNKTLIEELKALKDLYCHKVE

SEQ ID NO: 75 - protein, 121 aa, Homo sapiens
MAVTGDDTDEETELAPSHMAAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 76 - protein, 109 aa, Homo sapiens
MAVTGDDTAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 77 - protein, 270 aa, Homo sapiens
MWWHQHNLCFRRPIEEDYSSGDVEEKVAAIAETDESAESEGVIDSHKRREILSRRPSYRKILNELSSDVPGVPKIEEERSEEEGTPPSIATMAVPTSIYQTSTGQYIAIAQGGTIQISNPGSDGVQGLQALTMTNSGAPPPGATIVQYAAQSADGTQQFFVPGSQVVVQAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 78 - protein, 219 aa, Homo sapiens
MWWHQHNLCFRRPIEEDYSSGDVEEKVAAIAETDESAESEGVIDSHKRREILSRRPSYRKILNELSSDVPGVPKIEEERSEEEGTPPSIATMAVPTSIYQTSTGQYDEETELAPSHMATATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 79 - protein, 194 aa, Homo sapiens
MVAAIAETDESAESEGVIDSHKRREILSRRPSYRKILNELSSDVPGVPKIEEERSEEEGTPPSIATMAVPTSIYQTSTGQYDEETELAPSHMATATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 80 - protein, 312 aa, Homo sapiens
MSKCARKKYIKTNPRQMTMETVESQHDGSITASLTESKSAHVQTQTGQNSIPALAQVAAIAETDESAESEGVIDSHKRREILSRRPSYRKILNELSSDVPGVPKIEEERSEEEGTPPSIATMAVPTSIYQTSTGQYIAIAQGGTIQISNPGSDGVQGLQALTMTNSGAPPPGATIVQYAAQSADGTQQFFVPGSQVVVQDEETELAPSHMAAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 81 - protein, 300 aa, Homo sapiens
MSKCARKKYIKTNPRQMTMETVESQHDGSITASLTESKSAHVQTQTGQNSIPALAQVAAIAETDESAESEGVIDSHKRREILSRRPSYRKILNELSSDVPGVPKIEEERSEEEGTPPSIATMAVPTSIYQTSTGQYIAIAQGGTIQISNPGSDGVQGLQALTMTNSGAPPPGATIVQYAAQSADGTQQFFVPGSQVVVQAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 82 - protein, 221 aa, Homo sapiens
MSKCARKKYIKTNPRQMTMETVESQHDGSITASLTESKSAHVQTQTGQNSIPALAQVIAIAQGGTIQISNPGSDGVQGLQALTMTNSGAPPPGATIVQYAAQSADGTQQFFVPGSQVVVQAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 83 - protein, 170 aa, Homo sapiens
MSKCARKKYIKTNPRQMTMETVESQHDGSITASLTESKSAHVQTQTGQNSIPALAQVDEETELAPSHMAAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 84 - protein, 286 aa, Homo sapiens
MSKCARKKYIKTNPRQMTMETVESQHDGSITASLTESKSAHVQTQTGQNSIPALAQVSVAGSGTRRGSPAVTLVQLPSGQTIHVQGVIQTPQPWVIQSSEIHTVQVAAIAETDESAESEGVIDSHKRREILSRRPSYRKILNELSSDVPGVPKIEEERSEEEGTPPSIATMAVPTSIYQTSTGQYAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 85 - protein, 285 aa, Homo sapiens
MSKCARKKYIKTNPRQMTMETVESQHDGSITASLTESKSAHVQTQTGQNSIPALAQVSVAGSGTRRGSPAVTLVQLPSGQTIHVQGVIQTPQPWVIQSSEIHTVQVAAIAETDESAESEGVIDSHKRREILSRRPSYRKILNELSSDVPGVPKIEEERSEEEGTPPSIATMAVPTSIYQTSTGQYAATGDMPTYQIRAPTAALPQGVVMAASPGSLHSPQQLAEEATRKRELRLMKNREAARECRRKKKEYVKCLENRVAVLENQNKTLIEELKALKDLYCHKVE

SEQ ID NO: 86 - protein, 282 aa, Homo sapiens
MWWHQHNLCFRRPIEEDYSSGDVEEKVAAIAETDESAESEGVIDSHKRREILSRRPSYRKILNELSSDVPGVPKIEEERSEEEGTPPSIATMAVPTSIYQTSTGQYIAIAQGGTIQISNPGSDGVQGLQALTMTNSGAPPPGATIVQYAAQSADGTQQFFVPGSQVVVQDEETELAPSHMAAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 87 - protein, 102 aa, Homo sapiens
MAAATGDMPTYQIRAPTAALPQGVVMAASPGSLHSPQQLAEEATRKRELRLMKNREAARECRRKKKEYVKCLENRVAVLENQNKTLIEELKALKDLYCHKVE

SEQ ID NO: 88 - protein, 112 aa, Homo sapiens
MNRTQELSGQLSAATGDMPTYQIRAPTAALPQGVVMAASPGSLHSPQQLAEEATRKRELRLMKNREAARECRRKKKEYVKCLENRVAVLENQNKTLIEELKALKDLYCHKVE

SEQ ID NO: 89 - protein, 137 aa, Homo sapiens
MTMETVESQHDGSITASLTESKSAHVQTQTGQNSIPALAQVAAIAETDESAESEGVIDSHKRREILSRRPSYRKILNELSSDVPGVPKIEEERSEEEGTPPSIATMAVPTSIYQTSTGQYSMYAAIRYDTVLALSLL

SEQ ID NO: 90 - protein, 248 aa, Homo sapiens
MSKCARKKYIKTNPRQMTMETVESQHDGSITASLTESKSAHVQTQTGQNSIPALAQVAAIAETDESAESEGVIDSHKRREILSRRPSYRKILNELSSDVPGVPKIEEERSEEEGTPPSIATMAVPTSIYQTSTGQYNEETELAPSHMAAATGDMPTYQIRAPTAALPQGVVMAASPGSLHSPQQLAEEATRKRELRLMKNREAARECRRKKKEYVKCLENRVAVLENQNKTLIEELKALKDLYCHKVE

SEQ ID NO: 91 - protein, 113 aa, Homo sapiens
MNRTQELSGQLSAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 92 - protein, 138 aa, Homo sapiens
MTNSGAPPPGATIVQYAAQSADGTQQFFVPGSQVVVQAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 93 - protein, 125 aa, Homo sapiens
MNRTQELSGQLSDEETELAPSHMAAATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 94 - protein, 221 aa, Homo sapiens
MTMETVESQHDGSITASLTESKSAHVQTQTGQNSIPALAQVAAIAETDESAESEGVIDSHKRREILSRRPSYRKILNELSSDVPGVPKIEEERSEEEGTPPSIATMAVPTSIYQTSTGQYTATGDMPTYQIRAPTAALPQGVVMAASPGSLHSPQQLAEEATRKRELRLMKNREAAKECRRRKKEYVKCLESRVAVLEVQNKKLIEELETLKDICSPKTDY

SEQ ID NO: 95 - protein, 299 aa, Homo sapiens
MSKCARKKYIKTNPRQMTMETVESQHDGSITASLTESKSAHVQTQTGQNSIPALAQVAAIAETDESAESEGVIDSHKRREILSRRPSYRKILNELSSDVPGVPKIEEERSEEEGTPPSIATMAVPTSIYQTSTGQYIAIAQGGTIQISNPGSDGVQGLQALTMTNSGAPPPGATIVQYAAQSADGTQQFFVPGSQVVVQAATGDMPTYQIRAPTAALPQGVVMAASPGSLHSPQQLAEEATRKRELRLMKNREAARECRRKKKEYVKCLENRVAVLENQNKTLIEELKALKDLYCHKVE

SEQ ID NO: 96 - protein, 236 aa, Homo sapiens
MSKCARKKYIKTNPRQMTMETVESQHDGSITASLTESKSAHVQTQTGQNSIPALAQVAAIAETDESAESEGVIDSHKRREILSRRPSYRKILNELSSDVPGVPKIEEERSEEEGTPPSIATMAVPTSIYQTSTGQYTATGDMPTYQIRAPTAALPQGVVMAASPGSLHSPQQLAEEATRKRELRLMKNREAARECRRKKKEYVKCLENRVAVLENQNKTLIEELKALKDLYCHKVE

SEQ ID NO: 97 - protein, 376 aa, Homo sapiens
MQWTSLLLLAGLFSLSQAQYEDDPHWWFHYLRSQQSTYYDPYDPYPYETYEPYPYGVDEGPAYTYGSPSPPDPRDCPQECDCPPNFPTAMYCDNRNLKYLPFVPSRMKYVYFQNNQITSIQEGVFDNATGLLWIALHGNQITSDKVGRKVFSKLRHLERLYLDHNNLTRMPGPLPRSLRELHLDHNQISRVPNNALEGLENLTALYLQHNEIQEVGSSMRGLRSLILLDLSYNHLRKVPDGLPSALEQLYMEHNNVYTVPDSYFRGAPKLLYVRLSHNSLTNNGLASNTFNSSSLLELDLSYNQLQKIPPVNTNLENLYLQGNRINEFSISSFCTVVDVVNFSKLQVLRLDGNEIKRSAMPADAPLCLRLASLIEI

SEQ ID NO: 98 - protein, 425 aa, Homo sapiens
MEPSATPGAQMGVPPGSREPSPVPPDYEDEFLRYLWRDYLYPKQYEWVLIAAYVAVFVVALVGNTLVCLAVWRNHHMRTVTNYFIVNLSLADVLVTAICLPASLLVDITESWLFGHALCKVIPYLQAVSVSVAVLTLSFIALDRWYAICHPLLFKSTARRARGSILGIWAVSLAIMVPQAAVMECSSVLPELANRTRLFSVCDERWADDLYPKIYHSCFFIVTYLAPLGLMAMAYFQIFRKLWGRQIPGTTSALVRNWKRPSDQLGDLEQGLSGEPQPRARAFLAEVKQMRARRKTAKMLMVVLLVFALCYLPISVLNVLKRVFGMFRQASDREAVYACFTFSHWLVYANSAANPIIYNFLSGKFREQFKAAFSCCLPGLGPCGSLKAPSPRSSASHKSLSLQSRCSISKISEHVVLTSVTTVLP

SEQ ID NO: 99 - protein, 639 aa, Homo sapiens
MDRVLLRWISLFWLTAMVEGLQVTVPDKKKVAMLFQPTVLRCHFSTSSHQPAVVQWKFKSYCQDRMGESLGMSSTRAQSLSKRNLEWDPYLDCLDSRRTVRVVASKQGSTVTLGDFYRGREITIVHDADLQIGKLMWGDSGLYYCIITTPDDLEGKNEDSVELLVLGRTGLLADLLPSFAVEIMPEWVFVGLVLLGVFLFFVLVGICWCQCCPHSCCCYVRCPCCPDSCCCPQALYEAGKAAKAGYPPSVSGVPGPYSIPSVPLGGAPSSGMLMDKPHPPPLAPSDSTGGSHSVRKGYRIQADKERDSMKVLYYVEKELAQFDPARRMRGRYNNTISELSSLHEEDSNFRQSFHQMRSKQFPVSGDLESNPDYWSGVMGGSSGASRGPSAMEYNKEDRESFRHSQPRSKSEMLSRKNFATGVPAVSMDELAAFADSYGQRPRRADGNSHEARGGSRFERSESRAHSGFYQDDSLEEYYGQRSRSREPLTDADRGWAFSPARRRPAEDAHLPRLVSRTPGTAPKYDHSYLGSARERQARPEGASRGGSLETPSKRSAQLGPRSASYYAWSPPGTYKAGSSQDDQEDASDDALPPYSELELTRGPSYRGRDLPYHSNSEKKRKKEPAKKTNDFPTRMSLVV

SEQ ID NO: 100 - protein, 620 aa, Homo sapiens
MNNFILLEEQLIKKSQQKRRTSPSNFKVRFFVLTKASLAYFEDRHGKKRTLKGSIELSRIKCVEIVKSDISIPCHYKYPFQVVHDNYLLYVFAPDRESRQRWVLALKEETRNNNSLVPKYHPNFWMDGKWRCCSQLEKLATGCAQYDPTKNASKKPLPPTPEDNRRPLWEPEETVVIALYDYQTNDPQELALRRNEEYCLLDSSEIHWWRVQDRNGHEGYVPSSYLVEKSPNNLETYEWYNKSISRDKAEKLLLDTGKEGAFMVRDSRTAGTYTVSVFTKAVVSENNPCIKHYHIKETNDNPKRYYVAEKYVFDSIPLLINYHQHNGGGLVTRLRYPVCFGRQKAPVTAGLRYGKWVIDPSELTFVQEIGSGQFGLVHLGYWLNKDKVAIKTIREGAMSEEDFIEEAEVMMKLSHPKLVQLYGVCLEQAPICLVFEFMEHGCLSDYLRTQRGLFAAETLLGMCLDVCEGMAYLEEACVIHRDLAARNCLVGENQVIKVSDFGMTRFVLDDQYTSSTGTKFPVKWASPEVFSFSRYSSKSDVWSFGVLMWEVFSEGKIPYENRSNSEVVEDISTGFRLYKPRLASTHVYQIMNHCWKERPEDRPAFSRLLRQLAEIAESGL

SEQ ID NO: 101 - protein, 665 aa, Homo sapiens
MLRERTVRLQYGSRVEAVYVLGTYLWTDVYSAAPAGAQTFSLKHSEHVWVEVVRDGEAEEVATNGKQRWLLSPSTTLRVTMSQASTEASSDKVTVNYYDEEGSIPIDQAGLFLTAIEISLDVDADRDGVVEKNNPKKASWTWGPEGQGAILLVNCDRETPWLPKEDCRDEKVYSKEDLKDMSQMILRTKGPDRLPAGYEIVLYISMSDSDKVGVFYVENPFFGQRYIHILGRRKLYHVVKYTGGSAELLFFVEGLCFPDEGFSGLVSIHVSLLEYMAQDIPLTPIFTDTVIFRIAPWIMTPNILPPVSVFVCCMKDNYLFLKEVKNLVEKTNCELKVCFQYLNRGDRWIQDEIEFGYIEAPHKGFPVVLDSPRDGNLKDFPVKELLGPDFGYVTREPLFESVTSLDSFGNLEVSPPVTVNGKTYPLGRILIGSSFPLSGGRRMTKVVRDFLKAQQVQAPVELYSDWLTVGHVDEFMSFVPIPGTKKFLLLMASTSACYKLFREKQKDGHGEAIMFKGLGGMSSKRITINKILSNESLVQENLYFQRCLDWNRDILKKELGLTEQDIIDLPALFKMDEDHRARAFFPNMVNMIVLDKDLGIPKPFGPQVEEECCLEMHVRGLLEPLGLECTFIDDISAYHKFLGEVHCGTNVRRKPFTFKWWHMVP

SEQ ID NO: 102 - protein, 437 aa, Homo sapiens
MLRERTVRLQYGSRVEAVYVLGTYLWTDVYSAAPAGAQTFSLKHSEHVWVEVVRDGEAEEVATNGKQRWLLSPSTTLRVTMSQASTEASSDKVTVNYYDEEGSIPIDQAGLFLTAIEISLDVDADRDGVVEKNNPKKASWTWGPEGQGAILLVNCDRETPWLPKEDCRDEKVYSKEDLKDMSQMILRTKGPDRLPAGYEIVLYISMSDSDKVGVFYVENPFFGQRYIHILGRRKLYHVVKYTGGSAELLFFVEGLCFPDEGFSGLVSIHVSLLEYMAQDIPLTPIFTDTVIFRIAPWIMTPNILPPVSVFVCCMKDNYLFLKEVKNLVEKTNCELKVCFQYLNRGDRWIQDEIEFGYIEAPHKGFPVVLDSPRDGNLKDFPVKELLGPDFGYVTREPLFESVTSLDSFGNLEVSPPVTVNGKTYPLGRILIGSSFPL

SEQ ID NO: 103 - protein, 809 aa, Homo sapiens
MEAEGSSAPARAGSGEGSDSAGGATLKAPKHLWRHEQHHQYPLRQPQFRLLHPHHHLPPPPPPSPQPQPQCPLQPPPPPPLPPPPPPPGAARGRYASSGATGRVRHRGYSDTERYLYCRAMDRTSYAVETGHRPGLKKSRMSWPSSFQGLRRFDVDNGTSAGRSPLDPMTSPGSGLILQANFVHSQRRESFLYRSDSDYDLSPKSMSRNSSIASDIHGDDLIVTPFAQVLASLRTVRNNFAALTNLQDRAPSKRSPMCNQPSINKATITEEAYQKLASETLEELDWCLDQLETLQTRHSVSEMASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 104 - protein, 673 aa, Homo sapiens
MMHVNNFPFRRHSWICFDVDNGTSAGRSPLDPMTSPGSGLILQANFVHSQRRESFLYRSDSDYDLSPKSMSRNSSIASDIHGDDLIVTPFAQVLASLRTVRNNFAALTNLQDRAPSKRSPMCNQPSINKATITEEAYQKLASETLEELDWCLDQLETLQTRHSVSEMASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 105 - protein, 604 aa, Homo sapiens
MSRNSSIASDIHGDDLIVTPFAQVLASLRTVRNNFAALTNLQDRAPSKRSPMCNQPSINKATITEEAYQKLASETLEELDWCLDQLETLQTRHSVSEMASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 106 - protein, 584 aa, Homo sapiens
MKEQPSCAGTGHPMAGYGRMAPFELASGPVKRLRTESPFPCLFAEEAYQKLASETLEELDWCLDQLETLQTRHSVSEMASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 107 - protein, 507 aa, Homo sapiens
MASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 108 - protein, 745 aa, Homo sapiens
MAQQTSPDTLTVPEVDNPHCPNPWLNEDLVKSLRENLLQHEKSKTARKSVSPKLSPVISPRNSPRLLRRMLLSSNIPKQRRFTVAHTCFDVDNGTSAGRSPLDPMTSPGSGLILQANFVHSQRRESFLYRSDSDYDLSPKSMSRNSSIASDIHGDDLIVTPFAQVLASLRTVRNNFAALTNLQDRAPSKRSPMCNQPSINKATITEEAYQKLASETLEELDWCLDQLETLQTRHSVSEMASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 109 - protein, 215 aa, Homo sapiens
MAQQTSPDTLTVPEVDNPHCPNPWLNEDLVKSLRENLLQHEKSKTARKSVSPKLSPVISPRNSPRLLRRMLLSSNIPKQRRFTVAHTCFDVDNGTSAGRSPLDPMTSPGSGLILQANFVHSQRRESFLYRSDSDYDLSPKSMSRNSSIASDIHGDDLIVTPFAQVLASLRTVRNNFAALTNLQDRAPSKRSPMCNQPSINKATITGLYNGIIAFL

SEQ ID NO: 110 - protein, 518 aa, Homo sapiens
MPEANYLLSVSWGYIKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 111 - protein, 687 aa, Homo sapiens
MAFVWDPLGATVPGPSTRAKSRLRFSKSYSFDVDNGTSAGRSPLDPMTSPGSGLILQANFVHSQRRESFLYRSDSDYDLSPKSMSRNSSIASDIHGDDLIVTPFAQVLASLRTVRNNFAALTNLQDRAPSKRSPMCNQPSINKATITEEAYQKLASETLEELDWCLDQLETLQTRHSVSEMASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 112 - protein, 679 aa, Homo sapiens
MSIIMKPRSRSTSSLRTAEAVCFDVDNGTSAGRSPLDPMTSPGSGLILQANFVHSQRRESFLYRSDSDYDLSPKSMSRNSSIASDIHGDDLIVTPFAQVLASLRTVRNNFAALTNLQDRAPSKRSPMCNQPSINKATITEEAYQKLASETLEELDWCLDQLETLQTRHSVSEMASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 113 - protein, 748 aa, Homo sapiens
MKRNTCDLLSRSKSASEETLHSSNEEEDPFRGMEPYLVRRLSCRNIQLPPLAFRQLEQADLKSESENIQRPTSLPLKILPLIAITSAESSGFDVDNGTSAGRSPLDPMTSPGSGLILQANFVHSQRRESFLYRSDSDYDLSPKSMSRNSSIASDIHGDDLIVTPFAQVLASLRTVRNNFAALTNLQDRAPSKRSPMCNQPSINKATITEEAYQKLASETLEELDWCLDQLETLQTRHSVSEMASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 114 - protein, 219 aa, Homo sapiens
MAQQTSPDTLTVPEVDNPHCPNPWLNEDLVKSLRENLLQHEKSKTARKSVSPKLSPVISPRNSPRLLRRMLLSSNIPKQRRFTVAHTCFDVDNGTSAGRSPLDPMTSPGSGLILQANFVHSQRRESFLYRSDSDYDLSPKSMSRNSSIASDIHGDDLIVTPFAQVLASLRTVRNNFAALTNLQDRAPSKRSPMCNQPSINKATITGSWMELNPYTLLDM

SEQ ID NO: 115 - protein, 176 aa, Homo sapiens
MKVLLCDLLLLSLFSSVFSSCQRDCLTCQEKLHPALDSFDLEVCILECEEKVFPSPLWTPCTKVMARSSWQLSPAAPEHVAAALYQPRASEMQHLRRMPRVRSLFQEQEEPEPGMEEAGEMEQKQLQKRFGGFTGARKSARKLANQKRFSEFMRQYLVLSMQSSQRRRTLHQNGNV

SEQ ID NO: 116 - protein, 112 aa, Homo sapiens
MARSSWQLSPAAPEHVAAALYQPRASEMQHLRRMPRVRSLFQEQEEPEPGMEEAGEMEQKQLQKRFGGFTGARKSARKLANQKRFSEFMRQYLVLSMQSSQRRRTLHQNGNV

SEQ ID NO: 117 - protein, 674 aa, Homo sapiens
MTIRHQGQQYRPRMAFLQKIEALVKDMQNPETGVRMQNQRVLVTSVPHAMTGSDVLQWIVQRLWISSLEAQNLGNFIVRYGYIYPLQDPKNLILKPDGSLYRFQTPYFWPTQQWPAEDTDYAIYLAKRNIKKKGILEEYEKENYNFLNQKMNYKWDFVIMQAKEQYRAGKERNKADRYALDCQEKAYWLVHRCPPGMDNVLDYGLDRVTNPNEVKVNQKQTVVAVKKEIMYYQQALMRSTVKSSVSLGGIVKYSEQFSSNDAIMSGCLPSNPWITDDTQFWDLNAKLVEIPTKMRVERWAFNFSELIRDPKGRQSFQYFLKKEFSGENLGFWEACEDLKYGDQSKVKEKAEEIYKLFLAPGARRWINIDGKTMDITVKGLKHPHRYVLDAAQTHIYMLMKKDSYARYLKSPIYKDMLAKAIEPQETTKKSSTLPFMRRHLRSSPSPVILRQLEEEAKAREAANTVDITQPGQHMAPSPHLTVYTGTCMPPSPSSPFSSSCRSPRKPFASPSRFIRRPSTTICPSPIRVALESSSGLEQKGECSGSMAPRGPSVTESSEASLDTSWPRSRPRAPPKARMALSFSRFLRRGCLASPVFARLSPKCPAVSHGRVQPLGDVGQQLPRLKSKRVANFFQIKMDVPTGSGTCLMDSEDAGTGESGDRATEKEVICPWESL

SEQ ID NO: 118 - protein, 469 aa, Homo sapiens
MTIRHQGQQYRPRMAFLQKIEALVKDMQNPETGVRMQNQRVLVTSVPHAMTGSDVLQWIVQRLWISSLEAQNLGNFIVRYGYIYPLQDPKNLILKPDGSLYRFQTPYFWPTQQWPAEDTDYAIYLAKRNIKKKGILEEYEKENYNFLNQKMNYKWDFVIMQAKEQYRAGKERNKADRYALDCQEKAYWLVHRCPPGMDNVLDYGLDRVTNPNEVKVNQKQTVVAVKKEIMYYQQALMRSTVKSSVSLGGIVKYSEQFSSNDAIMSGCLPSNPWITDDTQFWDLNAKLVEIPTKMRVERWAFNFSELIRDPKGRQSFQYFLKKEFSGENLGFWEACEDLKYGDQSKVKEKAEEIYKLFLAPGARRWINIDGKTMDITVKGLKHPHRYVLDAAQTHIYMLMKKDSYARYLKSPIYKDMLAKAIEPQETTKKSSTLPFMRRHLRSSPSPVILRQLEEEAKAREAANTVDITQ

SEQ ID NO: 119 - protein, 484 aa, Homo sapiens
MTIRHQGQQYRPRMAFLQKIEALVKDMQNPETGVRMQNQRVLVTSVPHAMTGSDVLQWIVQRLWISSLEAQNLGNFIVRYGYIYPLQDPKNLILKPDGSLYRFQTPYFWPTQQWPAEDTDYAIYLAKRNIKKKGILEEYEKENYNFLNQKMNYKWDFVIMQAKEQYRAGKERNKADRYALDCQEKAYWLVHRCPPGMDNVLDYGLDRVTNPNEVKKQTVVAVKKEIMYYQQALMRSTVKSSVSLGGIVKYSEQFSSNDAIMSGCLPSNPWITDDTQFWDLNAKLVEIPTKMRVERWAFNFSELIRDPKGRQSFQYFLKKEFSGENLGFWEACEDLKYGDQSKVKEKAEEIYKLFLAPGARRWINIDGKTMDITVKGLKHPHRYVLDAAQTHIYMLMKKDSYARYLKSPIYKDMLAKAIEPQETTKKSSTLPFMRRHLRSSPSPVILRQLEEEAKAREAANTVDITQVMSKLDRRSQLKKELPPK

SEQ ID NO: 120 - protein, 445 aa, Homo sapiens
MYYQQALMRSTVKSSVSLGGIVKYSEQFSSNDAIMSGCLPSNPWITDDTQFWDLNAKLVEIPTKMRVERWAFNFSELIRDPKGRQSFQYFLKKEFSGENLGFWEACEDLKYGDQSKVKEKAEEIYKLFLAPGARRWINIDGKTMDITVKGLKHPHRYVLDAAQTHIYMLMKKDSYARYLKSPIYKDMLAKAIEPQETTKKSSTLPFMRRHLRSSPSPVILRQLEEEAKAREAANTVDITQPGQHMAPSPHLTVYTGTCMPPSPSSPFSSSCRSPRKPFASPSRFIRRPSTTICPSPIRVALESSSGLEQKGECSGSMAPRGPSVTESSEASLDTSWPRSRPRAPPKARMALSFSRFLRRGCLASPVFARLSPKCPAVSHGRVQPLGDVGQQLPRLKSKRVANFFQIKMDVPTGSGTCLMDSEDAGTGESGDRATEKEVICPWESL

SEQ ID NO: 121 - protein, 671 aa, Homo sapiens
MTIRHQGQQYRPRMAFLQKIEALVKDMQNPETGVRMQNQRVLVTSVPHAMTGSDVLQWIVQRLWISSLEAQNLGNFIVRYGYIYPLQDPKNLILKPDGSLYRFQTPYFWPTQQWPAEDTDYAIYLAKRNIKKKGILEEYEKENYNFLNQKMNYKWDFVIMQAKEQYRAGKERNKADRYALDCQEKAYWLVHRCPPGMDNVLDYGLDRVTNPNEVKKQTVVAVKKEIMYYQQALMRSTVKSSVSLGGIVKYSEQFSSNDAIMSGCLPSNPWITDDTQFWDLNAKLVEIPTKMRVERWAFNFSELIRDPKGRQSFQYFLKKEFSGENLGFWEACEDLKYGDQSKVKEKAEEIYKLFLAPGARRWINIDGKTMDITVKGLKHPHRYVLDAAQTHIYMLMKKDSYARYLKSPIYKDMLAKAIEPQETTKKSSTLPFMRRHLRSSPSPVILRQLEEEAKAREAANTVDITQPGQHMAPSPHLTVYTGTCMPPSPSSPFSSSCRSPRKPFASPSRFIRRPSTTICPSPIRVALESSSGLEQKGECSGSMAPRGPSVTESSEASLDTSWPRSRPRAPPKARMALSFSRFLRRGCLASPVFARLSPKCPAVSHGRVQPLGDVGQQLPRLKSKRVANFFQIKMDVPTGSGTCLMDSEDAGTGESGDRATEKEVICPWESL

SEQ ID NO: 122 - protein, 937 aa, Homo sapiens
MHRPRRRGTRPPLLALLAALLLAARGAAAQETELSVSAELVPTSSWNISSELNKDSYLTLDEPMNNITTSLGQTAELHCKVSGNPPPTIRWFKNDAPVVQEPRRLSFRSTIYGSRLRIRNLDTTDTGYFQCVATNGKEVVSSTGVLFVKFGPPPTASPGYSDEYEEDGFCQPYRGIACARFIGNRTVYMESLHMQGEIENQITAAFTMIGTSSHLSDKCSQFAIPSLCHYAFPYCDETSSVPKPRDLCRDECEILENVLCQTEYIFARSNPMILMRLKLPNCEDLPQPESPEAANCIRIGIPMADPINKNHKCYNSTGVDYRGTVSVTKSGRQCQPWNSQYPHTHTFTALRFPELNGGHSYCRNPGNQKEAPWCFTLDENFKSDLCDIPACDSKDSKEKNKMEILYILVPSVAIPLAIALLFFFICVCRNNQKSSSAPVQRQPKHVRGQNVEMSMLNAYKPKSKAKELPLSAVRFMEELGECAFGKIYKGHLYLPGMDHAQLVAIKTLKDYNNPQQWTEFQQEASLMAELHHPNIVCLLGAVTQEQPVCMLFEYINQGDLHEFLIMRSPHSDVGCSSDEDGTVKSSLDHGDFLHIAIQIAAGMEYLSSHFFVHKDLAARNILIGEQLHVKISDLGLSREIYSADYYRVQSKSLLPIRWMPPEAIMYGKFSSDSDIWSFGVVLWEIFSFGLQPYYGFSNQEVIEMVRKRQLLPCSEDCPPRMYSLMTECWNEIPSRRPRFKDIHVRLRSWEGLSSHTSSTTPSGGNATTQTTSLSASPVSNLSNPRYPNYMFPSQGITPQGQIAGFIGPPIPQNQRFIPINGYPIPPGYAAFPAAHYQPTGPPRVIQHCPPPKSRSPSSASGSTSTGHVTSLPSSGSNQEANIPLLPHMSIPNHPGGMGITVFGNKSQKPYKIDSKQASLLGDANIHGHTESMISAEL

SEQ ID NO: 123 - protein, 388 aa, Homo sapiens
MLFEYINQGDLHEFLIMRSPHSDVGCSSDEDGTVKSSLDHGDFLHIAIQIAAGMEYLSSHFFVHKDLAARNILIGEQLHVKISDLGLSREIYSADYYRVQSKSLLPIRWMPPEAIMYGKFSSDSDIWSFGVVLWEIFSFGLQPYYGFSNQEVIEMVRKRQLLPCSEDCPPRMYSLMTECWNEIPSRRPRFKDIHVRLRSWEGLSSHTSSTTPSGGNATTQTTSLSASPVSNLSNPRYPNYMFPSQGITPQGQIAGFIGPPIPQNQRFIPINGYPIPPGYAAFPAAHYQPTGPPRVIQHCPPPKSRSPSSASGSTSTGHVTSLPSSGSNQEANIPLLPHMSIPNHPGGMGITVFGNKSQKPYKIDSKQASLLGDANIHGHTESMISAEL

SEQ ID NO: 124 - protein, 393 aa, Homo sapiens
MHRPRRRGTRPPLLALLAALLLAARGAAAQETELSVSAELVPTSSWNISSELNKDSYLTLDEPMNNITTSLGQTAELHCKVSGNPPPTIRWFKNDAPVVQEPRRLSFRSTIYGSRLRIRNLDTTDTGYFQCVATNGKEVVSSTGVLFVKFGPPPTASPGYSDEYEEDGFCQPYRGIACARFIGNRTVYMESLHMQGEIENQITAAFTMIGTSSHLSDKCSQFAIPSLCHYAFPYCDETSSVPKPRDLCRDECEILENVLCQTEYIFARSNPMILMRLKLPNCEDLPQPESPEAANCIRIGIPMADPINKNHKCYNSTGVDYRGTVSVTKSGRQCQPWNSQYPHTHTFTALRFPELNGGHSYCRNPGNQKEAPWCFTLDENFKSDLCDIPACGK

SEQ ID NO: 125 - protein, 291 aa, Homo sapiens
MSMLPTFGFTQEQVACVCEVLQQGGNIERLGRFLWSLPACEHLHKNESVLKAKAVVAFHRGNFRELYKILESHQFSPHNHAKLQQLWLKAHYIEAEKLRGRPLGAVGKYRVRRKFPLPRSIWDGEETSYCFKEKSRSVLREWYAHNPYPSPREKRELAEATGLTTTQVSNWFKNRRQRDRAAEAKERENNENSNSNSHNPLNGSGKSVLGSSEDEKTPSGTPDHSSSSPALLLSPPPPGLPSLHSLGHPPGPSAVPVPVPGGGGADPLQHHHGLQDSILNPMSANLVDLGS

SEQ ID NO: 126 - protein, 425 aa, Homo sapiens
MAPITTSREEFDEIPTVVGIFSAFGLVFTVSLFAWICCQRKSSKSNKTPPYKFVHVLKGVDIYPENLNSKKKFGADDKNEVKNKPAVPKNSLHLDLEKRDLNGNFPKTNLKPGSPSDLENATPKLFLEGEKESVSPESLKSSTSLTSEEKQEKLGTLFFSLEYNFERKAFVVNIKEARGLPAMDEQSMTSDPYIKMTILPEKKHKVKTRVLRKTLDPAFDETFTFYGIPYTQIQELALHFTILSFDRFSRDDIIGEVLIPLSGIELSEGKMLMNREIIKRNVRKSSGRGELLISLCYQSTTNTLTVVVLKARHLPKSDVSGLSDPYVKVNLYHAKKRISKKKTHVKKCTPNAVFNELFVFDIPCEGLEDISVEFLVLDSERGSRNEVIGQLVLGAAAEGTGGEHWKEICDYPRRQIAKWHVLCDG

SEQ ID NO: 127 - protein, 407 aa, Homo sapiens
MAPITTSREEFVSLFAWICCQRKSSKSNKTPPYKFVHVLKGVDIYPENLNSKKKFGADDKNEVKNKPAVPKNSLHLDLEKRDLNGNFPKTNLKPGSPSDLENATPKLFLEGEKESVSPESLKSSTSLTSEEKQEKLGTLFFSLEYNFERKAFVVNIKEARGLPAMDEQSMTSDPYIKMTILPEKKHKVKTRVLRKTLDPAFDETFTFYGIPYTQIQELALHFTILSFDRFSRDDIIGEVLIPLSGIELSEGKMLMNREIIKRNVRKSSGRGELLISLCYQSTTNTLTVVVLKARHLPKSDVSGLSDPYVKVNLYHAKKRISKKKTHVKKCTPNAVFNELFVFDIPCEGLEDISVEFLVLDSERGSRNEVIGQLVLGAAAEGTGGEHWKEICDYPRRQIAKWHVLCDG

SEQ ID NO: 128 - protein, 1170 aa, Homo sapiens
MGLAWGLGVLFLMHVCGTNRIPESGGDNSVFDIFELTGAARKGSGRRLVKGPDPSSPAFRIEDANLIPPVPDDKFQDLVDAVRAEKGFLLLASLRQMKKTRGTLLALERKDHSGQVFSVVSNGKAGTLDLSLTVQGKQHVVSVEEALLATGQWKSITLFVQEDRAQLYIDCEKMENAELDVPIQSVFTRDLASIARLRIAKGGVNDNFQGVLQNVRFVFGTTPEDILRNKGCSSSTSVLLTLDNNVVNGSSPAIRTNYIGHKTKDLQAICGISCDELSSMVLELRGLRTIVTTLQDSIRKVTEENKELANELRRPPLCYHNGVQYRNNEEWTVDSCTECHCQNSVTICKKVSCPIMPCSNATVPDGECCPRCWPSDSADDGWSPWSEWTSCSTSCGNGIQQRGRSCDSLNNRCEGSSVQTRTCHIQECDKRFKQDGGWSHWSPWSSCSVTCGDGVITRIRLCNSPSPQMNGKPCEGEARETKACKKDACPINGGWGPWSPWDICSVTCGGGVQKRSRLCNNPTPQFGGKDCVGDVTENQICNKQDCPIDGCLSNPCFAGVKCTSYPDGSWKCGACPPGYSGNGIQCTDVDECKEVPDACFNHNGEHRCENTDPGYNCLPCPPRFTGSQPFGQGVEHATANKQVCKPRNPCTDGTHDCNKNAKCNYLGHYSDPMYRCECKPGYAGNGIICGEDTDLDGWPNENLVCVANATYHCKKDNCPNLPNSGQEDYDKDGIGDACDDDDDNDKIPDDRDNCPFHYNPAQYDYDRDDVGDRCDNCPYNHNPDQADTDNNGEGDACAADIDGDGILNERDNCQYVYNVDQRDTDMDGVGDQCDNCPLEHNPDQLDSDSDRIGDTCDNNQDIDEDGHQNNLDNCPYVPNANQADHDKDGKGDACDHDDDNDGIPDDKDNCRLVPNPDQKDSDGDGRGDACKDDFDHDSVPDIDDICPENVDISETDFRRFQMIPLDPKGTSQNDPNWVVRHQGKELVQTVNCDPGLAVGYDEFNAVDFSGTFFINTERDDDYAGFVFGYQSSSRFYVVMWKQVTQSYWDTNPTRAQGYSGLSVKVVNSTTGPGEHLRNALWHTGNTPGQVRTLWHDPRHIGWKDFTAYRWRLSHRPKTGFIRVVMYEGKKIMADSGPIYDKTYAGGRLGLFVFSQEMVFFSDLKYECRDP

SEQ ID NO: 129 - protein, 1085 aa, Homo sapiens
MGLAWGLGVLFLMHVCGTLLALERKDHSGQVFSVVSNGKAGTLDLSLTVQGKQHVVSVEEALLATGQWKSITLFVQEDRAQLYIDCEKMENAELDVPIQSVFTRDLASIARLRIAKGGVNDNFQGVLQNVRFVFGTTPEDILRNKGCSSSTSVLLTLDNNVVNGSSPAIRTNYIGHKTKDLQAICGISCDELSSMVLELRGLRTIVTTLQDSIRKVTEENKELANELRRPPLCYHNGVQYRNNEEWTVDSCTECHCQNSVTICKKVSCPIMPCSNATVPDGECCPRCWPSDSADDGWSPWSEWTSCSTSCGNGIQQRGRSCDSLNNRCEGSSVQTRTCHIQECDKRFKQDGGWSHWSPWSSCSVTCGDGVITRIRLCNSPSPQMNGKPCEGEARETKACKKDACPINGGWGPWSPWDICSVTCGGGVQKRSRLCNNPTPQFGGKDCVGDVTENQICNKQDCPIDGCLSNPCFAGVKCTSYPDGSWKCGACPPGYSGNGIQCTDVDECKEVPDACFNHNGEHRCENTDPGYNCLPCPPRFTGSQPFGQGVEHATANKQVCKPRNPCTDGTHDCNKNAKCNYLGHYSDPMYRCECKPGYAGNGIICGEDTDLDGWPNENLVCVANATYHCKKDNCPNLPNSGQEDYDKDGIGDACDDDDDNDKIPDDRDNCPFHYNPAQYDYDRDDVGDRCDNCPYNHNPDQADTDNNGEGDACAADIDGDGILNERDNCQYVYNVDQRDTDMDGVGDQCDNCPLEHNPDQLDSDSDRIGDTCDNNQDIDEDGHQNNLDNCPYVPNANQADHDKDGKGDACDHDDDNDGIPDDKDNCRLVPNPDQKDSDGDGRGDACKDDFDHDSVPDIDDICPENVDISETDFRRFQMIPLDPKGTSQNDPNWVVRHQGKELVQTVNCDPGLAVGYDEFNAVDFSGTFFINTERDDDYAGFVFGYQSSSRFYVVMWKQVTQSYWDTNPTRAQGYSGLSVKVVNSTTGPGEHLRNALWHTGNTPGQVRTLWHDPRHIGWKDFTAYRWRLSHRPKTGFIRVVMYEGKKIMADSGPIYDKTYAGGRLGLFVFSQEMVFFSDLKYECRDP

SEQ ID NO: 130 - protein, 710 aa, Homo sapiens
MEEMEEELKCPVCGSFYREPIILPCSHNLCQACARNILVQTPESESPQSHRAAGSGVSDYDYLDLDKMSLYSEADSGYGSYGGFASAPTTPCQKSPNGVRVFPPAMPPPATHLSPALAPVPRNSCITCPQCHRSLILDDRGLRGFPKNRVLEGVIDRYQQSKAAALKCQLCEKAPKEATVMCEQCDVFYCDPCRLRCHPPRGPLAKHRLVPPAQGRVSRRLSPRKVSTCTDHELENHSMYCVQCKMPVCYQCLEEGKHSSHEVKALGAMWKLHKSQLSQALNGLSDRAKEAKEFLVQLRNMVQQIQENSVEFEACLVAQCDALIDALNRRKAQLLARVNKEHEHKLKVVRDQISHCTVKLRQTTGLMEYCLEVIKENDPSGFLQISDALIRRVHLTEDQWGKGTLTPRMTTDFDLSLDNSPLLQSIHQLDFVQVKASSPVPATPILQLEECCTHNNSATLSWKQPPLSTVPADGYILELDDGNGGQFREVYVGKETMCTVDGLHFNSTYNARVKAFNKTGVSPYSKTLVLQTSEVAWFAFDPGSAHSDIILSNDNLTVTCSSYDDRVVLGKTGFSKGIHYWELTVDRYDNHPDPAFGVARMDVMKDVMLGKDDKAWAMYVDNNRSWFMHNNSHTNRTEGGITKGATIGVLLDLNRKNLTFFINDEQQGPIAFDNVEGLFFPAVSLNRNVQVTLHTGLPVPDFYSSRASIA

SEQ ID NO: 131 - protein, 802 aa, Homo sapiens
MEEMEEELKCPVCGSFYREPIILPCSHNLCQACARNILVQTPESESPQSHRAAGSGVSDYDYLDLDKMSLYSEADSGYGSYGGFASAPTTPCQKSPNGVRVFPPAMPPPATHLSPALAPVPRNSCITCPQCHRSLILDDRGLRGFPKNRVLEGVIDRYQQSKAAALKCQLCEKAPKEATVMCEQCDVFYCDPCRLRCHPPRGPLAKHRLVPPAQGRVSRRLSPRKVSTCTDHELENHSMYCVQCKMPVCYQCLEEGKHSSHEVKALGAMWKLHKSQLSQALNGLSDRAKEAKEFLVQLRNMVQQIQENSVEFEACLVAQCDALIDALNRRKAQLLARVNKEHEHKLKVVRDQISHCTVKLRQTTGLMEYCLEVIKENDPSGFLQISDALIRRVHLTEDQWGKGTLTPRMTTDFDLSLDNSPLLQSIHQLDFVQVKVPATPILQLEECCTHNNSATLSWKQPPLSTVPADGYILELDDGNGGQFREVYVGKETMCTVDGLHFNSTYNARVKAFNKTGVSPYSKTLVLQTSEDTDSEEQTLPFPVPSERLPLRRMSPFSSTLNLQPSFPGRSYFDFRSSPHQLSLHSSLQSLNAPGCNFETQSAPYSQLVDIKKLLAVAWFAFDPGSAHSDIILSNDNLTVTCSSYDDRVVLGKTGFSKGIHYWELTVDRYDNHPDPAFGVARMDVMKDVMLGKDDKAWAMYVDNNRSWFMHNNSHTNRTEGGITKGATIGVLLDLNRKNLTFFINDEQQGPIAFDNVEGLFFPAVSLNRNVQVSTLPLRLNSCCWLPVQRLPRAVQSNRREGS

SEQ ID NO: 132 - protein, 550 aa, Homo sapiens
MEEMEEELKCPVCGSFYREPIILPCSHNLCQACARNILVQTPESESPQSHRAAGSGVSDYDYLDLDKMSLYSEADSGYGSYGGFASAPTTPCQKSPNGVRVFPPAMPPPATHLSPALAPVPRNSCITCPQCHRSLILDDRGLRGFPKNRVLEGVIDRYQQSKAAALKCQLCEKAPKEATVMCEQCDVFYCDPCRLRCHPPRGPLAKHRLVPPAQGRVSRRLSPRKVSTCTDHELENHSMYCVQCKMPVCYQCLEEGKHSSHEVKALGAMWKLHKSQLSQALNGLSDRAKEAKEFLVQLRNMVQQIQENSVEFEACLVAQCDALIDALNRRKAQLLARVNKEHEHKLKVVRDQISHCTVKLRQTTGLMEYCLEVIKENDPSGFLQISDALIRRVHLTEDQWGKGTLTPRMTTDFDLSLDNSPLLQSIHQLDFVQVKASSPVPATPILQLEECCTHNNSATLSWKQPPLSTVPADGYILELDDGNGGQFREVYVGKETMCTVDGLHFNSTYNARVKAFNKTGVSPYSKTLVLQTSEGKALQQYPSERELRGI

SEQ ID NO: 133 - protein, 824 aa, Homo sapiens
MRGLGLWLLGAMMLPAIAPSRPWALMEQYEVVLPWRLPGPRVRRALPSHLGLHPERVSYVLGATGHNFTLHLRKNRDLLGSGYTETYTAANGSEVTEQPRGQDHCFYQGHVEGYPDSAASLSTCAGLRGFFQVGSDLHLIEPLDEGGEGGRHAVYQAEHLLQTAGTCGVSDDSLGSLLGPRTAAVFRPRPGDSLPSRETRYVELYVVVDNAEFQMLGSEAAVRHRVLEVVNHVDKLYQKLNFRVVLVGLEIWNSQDRFHVSPDPSVTLENLLTWQARQRTRRHLHDNVQLITGVDFTGTTVGFARVSAMCSHSSGAVNQDHSKNPVGVACTMAHEMGHNLGMDHDENVQGCRCQERFEAGRCIMAGSIGSSFPRMFSDCSQAYLESFLERPQSVCLANAPDLSHLVGGPVCGNLFVERGEQCDCGPPEDCRNRCCNSTTCQLAEGAQCAHGTCCQECKVKPAGELCRPKKDMCDLEEFCDGRHPECPEDAFQENGTPCSGGYCYNGACPTLAQQCQAFWGPGGQAAEESCFSYDILPGCKASRYRADMCGVLQCKGGQQPLGRAICIVDVCHALTTEDGTAYEPVPEGTRCGPEKVCWKGRCQDLHVYRSSNCSAQCHNHGVCNHKQECHCHAGWAPPHCAKLLTEVHAASGSLPVFVVVVLVLLAVVLVTLAGIIVYRKARSRILSRNVAPKTTMGRSNPLFHQAASRVPAKGGAPAPSRGPQELVPTTHPGQPARHPASSVALKRPPPAPPVTVSSPPFPVPVYTRQAPKQVIKPTFAPPVPPVKPGAGAANPGPAEGAVGPKVALKPPIQRKQGAGAPTAP

SEQ ID NO: 134 - protein, 733 aa, Homo sapiens
MRGLGLWLLGAMMLPGPAPREGELRPWGHRAQLHPPPAEEQGPAGLRLHRDLYGCQWLRGDGAASRAGPLLLPGPRRGVPGLSRQPQHLCRPQVGSDLHLIEPLDEGGEGGRHAVYQAEHLLQTAGTCGVSDDSLGSLLGPRTAAVFRPRPGDSLPSRETRYVELYVVVDNAEFQMLGSEAAVRHRVLEVVNHVDKLYQKLNFRVVLVGLEIWNSQDRFHVSPDPSVTLENLLTWQARQRTRRHLHDNVQLITGVDFTGTTVGFARVSAMCSHSSGAVNQDHSKNPVGVACTMAHEMGHNLGMDHDENVQGCRCQERFEAGRCIMAGSIGSSFPRMFSDCSQAYLESFLERPQSVCLANAPDLSHLVGGPVCGNLFVERGEQCDCGPPEDCRNRCCNSTTCQLAEGAQCAHGTCCQECKVKPAGELCRPKKDMCDLEEFCDGRHPECPEDAFQENGTPCSGGYCYNGACPTLAQQCQAFWGPGGQAAEESCFSYDILPGCKASRYRADMCGVLQCKGGQQPLGRAICIVDVCHALTTEDGTAYEPVPEGTRCGPEKVCNHKQECHCHAGWAPPHCAKLLTEVHAASGSLPVFVVVVLVLLAVVLVTLAGIIVYRKARSRILSRNVAPKTTMGRSNPLFHQAASRVPAKGGAPAPSRGPQELVPTTHPGQPARHPASSVALKRPPPAPPVTVSSPPFPVPVYTRQAPKQGAVGPKVALKPPIQRKQGAGAPTAP

SEQ ID NO: 135 - protein, 742 aa, Homo sapiens
MRGLGLWLLGAMMLPAIAPSRPWALMEQYEVVLPWRLPGPRVRRALPSHLGLHPERVSYVLGATGHNFTLHLRKNRDLLGSGYTETYTAANGSEVTEQPRGQDHCFYQGHVEGYPDSAASLSTCAGLRGFFQVGSDLHLIEPLDEGGEGGRHAVYQAEHLLQTAGTCGVSDDSLGSLLGPRTAAVFRPRPGDSLPSRETRYVELYVVVDNAEFQMLGSEAAVRHRVLEVVNHVDKLYQKLNFRVVLVGLEIWNSQDRFHVSPDPSVTLENLLTWQARQRTRRHLHDNVQLITGVDFTGTTVGFARVSAMCSHSSGAVNQDHSKNPVGVACTMAHEMGHNLGMDHDENVQGCRCQERFEAGRCIMAGSIGSSFPRMFSDCSQAYLESFLERPQSVCLANAPDLSHLVGGPVCGNLFVERGEQCDCGPPEDCRNRCCNSTTCQLAEGAQCAHGTCCQECKVKPAGELCRPKKDMCDLEEFCDGRHPECPEDAFQENGTPCSGGYCYNGACPTLAQQCQAFWGPGGQAAEESCFSYDILPGCKASRYRADMCGVLQCKGGQQPLGRAICIVDVCHALTTEDGTAYEPVPEGTRCGPEKVCWKGRCQDLHVYRSSNCSAQCHNHGVCNHKQECHCHAGWAPPHCAKLLTEVHAGCQPRAGQGRGSSPIQGPPRAGPHHPPGPARPTPGLLGGSEEAAPCSSGHCVQPTLPSSCLHPAGTKAGHQANVRTPSAPSQTRGWCGQPWSS

SEQ ID NO: 136 - protein, 359 aa, Homo sapiens
MSLQRLLQHSSNGNLADFCAGPAYSSYSTLTGSLTMDDNRRIQMLADTVATLPRGRKQLALTRSSSLSDFSWSQRKLVTVEKQDNETFGFEIQSYRPQNQNACSSEMFTLICKIQEDSPAHCAGLQAGDVLANINGVSTEGFTYKQVVDLIRSSGNLLTIETLNGTMILKRTELEAKLQVLKQTLKQKWVEYRSLQLQEHRLLHGDAANCPSLENMDLDELSLFGPLPGPGPALVDRNRLSSESSCKSWLSSMTMDSEDGYQTCVSEDSSRGAFSRQTSTDDECFIPKEGDDFLRRSSSRRNRSISNTSSGSMSPLWEGNLSSMFGTLPRKSRKGSVRKQLLKFIPGLHRAVEEEESRF

SEQ ID NO: 137 - protein, 253 aa, Homo sapiens
MFTLICKIQEDSPAHCAGLQAGDVLANINGVSTEGFTYKQVVDLIRSSGNLLTIETLNGTMILKRTELEAKLQVLKQTLKQKWVEYRSLQLQEHRLLHGDAANCPSLENMDLDELSLFGPLPGPGPALVDRNRLSSESSCKSWLSSMTMDSEDGYQTCVSEDSSRGAFSRQTSTDDECFIPKEGDDFLRRSSSRRNRSISNTSSGSMSPLWEGNLSSMFGTLPRKSRKGSVRKQLLKFIPGLHRAVEEEESRF

SEQ ID NO: 138 - protein, 931 aa, Homo sapiens
MDMFPLTWVFLALYFSRHQVRGQPDPPCGGRLNSKDAGYITSPGYPQDYPSHQNCEWIVYAPEPNQKIVLNFNPHFEIEKHDCKYDFIEIRDGDSESADLLGKHCGNIAPPTIISSGSMLYIRFTSDYARQGAGFSLRYEIFKTGSEDCSKNFTSPNGTIESPGFPEKYPHNLDCTFTILAKPKMEIILQFLIFDLEHDPLQVGEGDCKYDWLDIWDGIPHVGPLIGKYCGTKTPSELRSSTGILSLTFHTDMAVAKDGFSARYYLVHQEPLENFQCNVPLGMESGRIANEQISASSTYSDGRWTPQQSRLHGDDNGWTPNLDSNKEYLQVDLRFLTMLTAIATQGAISRETQNGYYVKSYKLEVSTNGEDWMVYRHGKNHKVFQANNDATEVVLNKLHAPLLTRFVRIRPQTWHSGIALRLELFGCRVTDAPCSNMLGMLSGLIADSQISASSTQEYLWSPSAARLVSSRSGWFPRIPQAQPGEEWLQVDLGTPKTVKGVIIQGARGGDSITAVEARAFVRKFKVSYSLNGKDWEYIQDPRTQQPKLFEGNMHYDTPDIRRFDPIPAQYVRVYPERWSPAGIGMRLEVLGCDWTDSKPTVETLGPTVKSEETTTPYPTEEEATECGENCSFEDDKDLQLPSGFNCNFDFLEEPCGWMYDHAKWLRTTWASSSSPNDRTFPDDRNFLRLQSDSQREGQYARLISPPVHLPRSPVCMEFQYQATGGRGVALQVVREASQESKLLWVIREDQGGEWKHGRIILPSYDMEYQIVFEGVIGKGRSGEIAIDDIRISTDVPLENCMEPISAFAGENFKVDIPEIHEREGYEDEIDDEYEVDWSNSSSATSGSGAPSTDKEKSWLYTLDPILITIIAMSSLGVLLGATCAGLLLYCTCSYSGLSSRSCTTLENYNFELYDGLKHKVKMNHQKCCSEA

SEQ ID NO: 139 - protein, 909 aa, Homo sapiens
MDMFPLTWVFLALYFSRHQVRGQPDPPCGGRLNSKDAGYITSPGYPQDYPSHQNCEWIVYAPEPNQKIVLNFNPHFEIEKHDCKYDFIEIRDGDSESADLLGKHCGNIAPPTIISSGSMLYIRFTSDYARQGAGFSLRYEIFKTGSEDCSKNFTSPNGTIESPGFPEKYPHNLDCTFTILAKPKMEIILQFLIFDLEHDPLQVGEGDCKYDWLDIWDGIPHVGPLIGKYCGTKTPSELRSSTGILSLTFHTDMAVAKDGFSARYYLVHQEPLENFQCNVPLGMESGRIANEQISASSTYSDGRWTPQQSRLHGDDNGWTPNLDSNKEYLQVDLRFLTMLTAIATQGAISRETQNGYYVKSYKLEVSTNGEDWMVYRHGKNHKVFQANNDATEVVLNKLHAPLLTRFVRIRPQTWHSGIALRLELFGCRVTDAPCSNMLGMLSGLIADSQISASSTQEYLWSPSAARLVSSRSGWFPRIPQAQPGEEWLQVDLGTPKTVKGVIIQGARGGDSITAVEARAFVRKFKVSYSLNGKDWEYIQDPRTQQPKLFEGNMHYDTPDIRRFDPIPAQYVRVYPERWSPAGIGMRLEVLGCDWTDSKPTVETLGPTVKSEETTTPYPTEEEATECGENCSFEDDKDLQLPSGFNCNFDFLEEPCGWMYDHAKWLRTTWASSSSPNDRTFPDDRNFLRLQSDSQREGQYARLISPPVHLPRSPVCMEFQYQATGGRGVALQVVREASQESKLLWVIREDQGGEWKHGRIILPSYDMEYQIVFEGVIGKGRSGEIAIDDIRISTDVPLENCMEPISAFADEYEVDWSNSSSATSGSGAPSTDKEKSWLYTLDPILITIIAMSSLGVLLGATCAGLLLYCTCSYSGLSSRSCTTLENYNFELYDGLKHKVKMNHQKCCSEA

SEQ ID NO: 140 - protein, 926 aa, Homo sapiens
MDMFPLTWVFLALYFSRHQVRGQPDPPCGGRLNSKDAGYITSPGYPQDYPSHQNCEWIVYAPEPNQKIVLNFNPHFEIEKHDCKYDFIEIRDGDSESADLLGKHCGNIAPPTIISSGSMLYIRFTSDYARQGAGFSLRYEIFKTGSEDCSKNFTSPNGTIESPGFPEKYPHNLDCTFTILAKPKMEIILQFLIFDLEHDPLQVGEGDCKYDWLDIWDGIPHVGPLIGKYCGTKTPSELRSSTGILSLTFHTDMAVAKDGFSARYYLVHQEPLENFQCNVPLGMESGRIANEQISASSTYSDGRWTPQQSRLHGDDNGWTPNLDSNKEYLQVDLRFLTMLTAIATQGAISRETQNGYYVKSYKLEVSTNGEDWMVYRHGKNHKVFQANNDATEVVLNKLHAPLLTRFVRIRPQTWHSGIALRLELFGCRVTDAPCSNMLGMLSGLIADSQISASSTQEYLWSPSAARLVSSRSGWFPRIPQAQPGEEWLQVDLGTPKTVKGVIIQGARGGDSITAVEARAFVRKFKVSYSLNGKDWEYIQDPRTQQPKLFEGNMHYDTPDIRRFDPIPAQYVRVYPERWSPAGIGMRLEVLGCDWTDSKPTVETLGPTVKSEETTTPYPTEEEATECGENCSFEDDKDLQLPSGFNCNFDFLEEPCGWMYDHAKWLRTTWASSSSPNDRTFPDDRNFLRLQSDSQREGQYARLISPPVHLPRSPVCMEFQYQATGGRGVALQVVREASQESKLLWVIREDQGGEWKHGRIILPSYDMEYQIVFEGVIGKGRSGEIAIDDIRISTDVPLENCMEPISAFAVDIPEIHEREGYEDEIDDEYEVDWSNSSSATSGSGAPSTDKEKSWLYTLDPILITIIAMSSLGVLLGATCAGLLLYCTCSYSGLSSRSCTTLENYNFELYDGLKHKVKMNHQKCCSEA

SEQ ID NO: 141 - protein, 901 aa, Homo sapiens
MDMFPLTWVFLALYFSRHQVRGQPDPPCGGRLNSKDAGYITSPGYPQDYPSHQNCEWIVYAPEPNQKIVLNFNPHFEIEKHDCKYDFIEIRDGDSESADLLGKHCGNIAPPTIISSGSMLYIRFTSDYARQGAGFSLRYEIFKTGSEDCSKNFTSPNGTIESPGFPEKYPHNLDCTFTILAKPKMEIILQFLIFDLEHDPLQVGEGDCKYDWLDIWDGIPHVGPLIGKYCGTKTPSELRSSTGILSLTFHTDMAVAKDGFSARYYLVHQEPLENFQCNVPLGMESGRIANEQISASSTYSDGRWTPQQSRLHGDDNGWTPNLDSNKEYLQVDLRFLTMLTAIATQGAISRETQNGYYVKSYKLEVSTNGEDWMVYRHGKNHKVFQANNDATEVVLNKLHAPLLTRFVRIRPQTWHSGIALRLELFGCRVTDAPCSNMLGMLSGLIADSQISASSTQEYLWSPSAARLVSSRSGWFPRIPQAQPGEEWLQVDLGTPKTVKGVIIQGARGGDSITAVEARAFVRKFKVSYSLNGKDWEYIQDPRTQQPKLFEGNMHYDTPDIRRFDPIPAQYVRVYPERWSPAGIGMRLEVLGCDWTDSKPTVETLGPTVKSEETTTPYPTEEEATECGENCSFEDDKDLQLPSGFNCNFDFLEEPCGWMYDHAKWLRTTWASSSSPNDRTFPDDRNFLRLQSDSQREGQYARLISPPVHLPRSPVCMEFQYQATGGRGVALQVVREASQESKLLWVIREDQGGEWKHGRIILPSYDMEYQIVFEGVIGKGRSGEIAIDDIRISTDVPLENCMEPISAFAGGTLLPGTEPTVDTVPMQPIPAYWYYVMAAGGAVLVLVSVALALVLHYHRFRYAAKKTDHSITYKTSHYTNGAPLAVEPTLTIKLEQDRGSHC

SEQ ID NO: 142 - protein, 906 aa, Homo sapiens
MDMFPLTWVFLALYFSRHQVRGQPDPPCGGRLNSKDAGYITSPGYPQDYPSHQNCEWIVYAPEPNQKIVLNFNPHFEIEKHDCKYDFIEIRDGDSESADLLGKHCGNIAPPTIISSGSMLYIRFTSDYARQGAGFSLRYEIFKTGSEDCSKNFTSPNGTIESPGFPEKYPHNLDCTFTILAKPKMEIILQFLIFDLEHDPLQVGEGDCKYDWLDIWDGIPHVGPLIGKYCGTKTPSELRSSTGILSLTFHTDMAVAKDGFSARYYLVHQEPLENFQCNVPLGMESGRIANEQISASSTYSDGRWTPQQSRLHGDDNGWTPNLDSNKEYLQVDLRFLTMLTAIATQGAISRETQNGYYVKSYKLEVSTNGEDWMVYRHGKNHKVFQANNDATEVVLNKLHAPLLTRFVRIRPQTWHSGIALRLELFGCRVTDAPCSNMLGMLSGLIADSQISASSTQEYLWSPSAARLVSSRSGWFPRIPQAQPGEEWLQVDLGTPKTVKGVIIQGARGGDSITAVEARAFVRKFKVSYSLNGKDWEYIQDPRTQQPKLFEGNMHYDTPDIRRFDPIPAQYVRVYPERWSPAGIGMRLEVLGCDWTDSKPTVETLGPTVKSEETTTPYPTEEEATECGENCSFEDDKDLQLPSGFNCNFDFLEEPCGWMYDHAKWLRTTWASSSSPNDRTFPDDRNFLRLQSDSQREGQYARLISPPVHLPRSPVCMEFQYQATGGRGVALQVVREASQESKLLWVIREDQGGEWKHGRIILPSYDMEYQIVFEGVIGKGRSGEIAIDDIRISTDVPLENCMEPISAFAGENFKGGTLLPGTEPTVDTVPMQPIPAYWYYVMAAGGAVLVLVSVALALVLHYHRFRYAAKKTDHSITYKTSHYTNGAPLAVEPTLTIKLEQDRGSHC

SEQ ID NO: 143 - protein, 555 aa, Homo sapiens
MDMFPLTWVFLALYFSRHQVRGQPDPPCGGRLNSKDAGYITSPGYPQDYPSHQNCEWIVYAPEPNQKIVLNFNPHFEIEKHDCKYDFIEIRDGDSESADLLGKHCGNIAPPTIISSGSMLYIRFTSDYARQGAGFSLRYEIFKTGSEDCSKNFTSPNGTIESPGFPEKYPHNLDCTFTILAKPKMEIILQFLIFDLEHDPLQVGEGDCKYDWLDIWDGIPHVGPLIGKYCGTKTPSELRSSTGILSLTFHTDMAVAKDGFSARYYLVHQEPLENFQCNVPLGMESGRIANEQISASSTYSDGRWTPQQSRLHGDDNGWTPNLDSNKEYLQVDLRFLTMLTAIATQGAISRETQNGYYVKSYKLEVSTNGEDWMVYRHGKNHKVFQANNDATEVVLNKLHAPLLTRFVRIRPQTWHSGIALRLELFGCRVTDAPCSNMLGMLSGLIADSQISASSTQEYLWSPSAARLVSSRSGWFPRIPQAQPGEEWLQVDLGTPKTVKGVIIQGARGGDSITAVEARAFVRKFKVSYSLNGKDWEYIQDPRTQQPKVGCSWRPL

SEQ ID NO: 144 - protein, 666 aa, Homo sapiens
MTPPPPGRAAPSAPRARVPGPPARLGLPLRLRLLLLLWAAAASAQGHLRSGPRIFAVWKGHVGQDRVDFGQTEPHTVLFHEPGSSSVWVGGRGKVYLFDFPEGKNASVRTVNIGSTKGSCLDKRDCENYITLLERRSEGLLACGTNARHPSCWNLVNGTVVPLGEMRGYAPFSPDENSLVLFEGDEVYSTIRKQEYNGKIPRFRRIRGESELYTSDTVMQNPQFIKATIVHQDQAYDDKIYYFFREDNPDKNPEAPLNVSRVAQLCRGDQGGESSLSVSKWNTFLKAMLVCSDAATNKNFNRLQDVFLLPDPSGQWRDTRVYGVFSNPWNYSAVCVYSLGDIDKVFRTSSLKGYHSSLPNPRPGKCLPDQQPIPTETFQVADRHPEVAQRVEPMGPLKTPLFHSKYHYQKVAVHRMQASHGETFHVLYLTTDRGTIHKVVEPGEQEHSFAFNIMEIQPFRRAAAIQTMSLDAERRKLYVSSQWEVSQVPLDLCEVYGGGCHGCLMSRDPYCGWDQGRCISIYSSERSVLQSINPAEPHKECPNPKPDKAPLQKVSLAPNSRYYLSCPMESRHATYSWRHKENVEQSCEPGHQSPNCILFIENLTAQQYGHYFCEAQEGSYFREAQHWQLLPEDGIMAEHLLGHACALAASLWLGVLPTLTLGLLVH

SEQ ID NO: 145 - protein, 652 aa, Homo sapiens
MTPPPPGRAAPSAPRARVPGPPARLGLPLRLRLLLLLWAAAASAQGHLRSGPRIFAVWKGHVGQDRVDFGQTEPHTVLFHEPGSSSVWVGGRGKVYLFDFPEGKNASVRTDCENYITLLERRSEGLLACGTNARHPSCWNLVNGTVVPLGEMRGYAPFSPDENSLVLFEGDEVYSTIRKQEYNGKIPRFRRIRGESELYTSDTVMQNPQFIKATIVHQDQAYDDKIYYFFREDNPDKNPEAPLNVSRVAQLCRGDQGGESSLSVSKWNTFLKAMLVCSDAATNKNFNRLQDVFLLPDPSGQWRDTRVYGVFSNPWNYSAVCVYSLGDIDKVFRTSSLKGYHSSLPNPRPGKCLPDQQPIPTETFQVADRHPEVAQRVEPMGPLKTPLFHSKYHYQKVAVHRMQASHGETFHVLYLTTDRGTIHKVVEPGEQEHSFAFNIMEIQPFRRAAAIQTMSLDAERRKLYVSSQWEVSQVPLDLCEVYGGGCHGCLMSRDPYCGWDQGRCISIYSSERSVLQSINPAEPHKECPNPKPDKAPLQKVSLAPNSRYYLSCPMESRHATYSWRHKENVEQSCEPGHQSPNCILFIENLTAQQYGHYFCEAQEGSYFREAQHWQLLPEDGIMAEHLLGHACALAASLWLGVLPTLTLGLLVH

SEQ ID NO: 146 - protein, 400 aa, Homo sapiens
MSSLHKSRIADFQDVLKEPSIALEKLRELSFSGIPCEGGLRCLCWKILLNYLPLERASWTSILAKQRELYAQFLREMIIQPGIAKANMGVSREDVTFEDHPLNPNPDSRWNTYFKDNEVLLQIDKDVRRLCPDISFFQRATDYPCLLILDPQNEFETLRKRVEQTTLKSQTVARNRSGVTNMSSPHKNSVPSSLNEYEVLPNGCEAHWEVVERILFIYAKLNPGIAYVQGMNEIVGPLYYTFATDPNSEWKEHAEADTFFCFTNLMAEIRDNFIKSLDDSQCGITYKMEKVYSTLKDKDVELYLKLQEQNIKPQFFAFRWLTLLLSQEFLLPDVIRIWDSLFADDNRFDFLLLVCCAMLMLIREQLLEGDFTVNMRLLQDYPITDVCQILQKAKELQDSK

SEQ ID NO: 147 - protein, 275 aa, Homo sapiens
MSSLHKSRIADFQDVLKEPSIALEKLRELSFSGIPCEGGLRCLCWKILLNYLPLERASWTSILAKQRELYAQFLREMIIQPGIAKANMGVSREDVTFEDHPLNPNPDSRWNTYFKDNEVLLQIDKDVRRLCPDISFFQRATDYPCLLILDPQNEFETLRKRVEQTTLKSQTVARNRSGVTNQEQNIKPQFFAFRWLTLLLSQEFLLPDVIRIWDSLFADDNRFDFLLLVCCAMLMLIREQLLEGDFTVNMRLLQDYPITDVCQILQKAKELQDSK

SEQ ID NO: 148 - protein, 219 aa, Homo sapiens
MSSPHKNSVPSSLNEYEVLPNGCEAHWEVVERILFIYAKLNPGIAYVQGMNEIVGPLYYTFATDPNSEWKEHAEADTFFCFTNLMAEIRDNFIKSLDDSQCGITYKMEKVYSTLKDKDVELYLKLQEQNIKPQFFAFRWLTLLLSQEFLLPDVIRIWDSLFADDNRFDFLLLVCCAMLMLIREQLLEGDFTVNMRLLQDYPITDVCQILQKAKELQDSK

SEQ ID NO: 149 - protein, 183 aa, Homo sapiens
MERVQPLEENVGNAARPRFERNKLLLVASVIQGLGLLLCFTYICLHFSALQVSHRYPRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVL

SEQ ID NO: 150 - protein, 133 aa, Homo sapiens
MVSHRYPRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVL

SEQ ID NO: 151 - protein, 575 aa, Homo sapiens
MLGVLVLGALALAGLGFPAPAEPQPGGSQCVEHDCFALYPGPATFLNASQICDGLRGHLMTVRSSVAADVISLLLNGDGGVGRRRLWIGLQLPPGCGDPKRLGPLRGFQWVTGDNNTSYSRWARLDLNGAPLCGPLCVAVSAAEATVPSEPIWEEQQCEVKADGFLCEFHFPATCRPLAVEPGAAAAAVSITYGTPFAARGADFQALPVGSSAAVAPLGLQLMCTAPPGAVQGHWAREAPGAWDCSVENGGCEHACNAIPGAPRCQCPAGAALQADGRSCTASATQSCNDLCEHFCVPNPDQPGSYSCMCETGYRLAADQHRCEDVDDCILEPSPCPQRCVNTQGGFECHCYPNYDLVDGECVEPVDPCFRANCEYQCQPLNQTSYLCVCAEGFAPIPHEPHRCQMFCNQTACPADCDPNTQASCECPEGYILDDGFICTDIDECENGGFCSGVCHNLPGTFECICGPDSALARHIGTDCDSGKVDGGDSGSGEPPPSPTPGSTLTPPAVGLVHSGLLIGISIASLCLVVALLALLCHLRKKQGAARAKMEYKCAAPSKEVVLQHVRTERTPQRL

SEQ ID NO: 152 - protein, 253 aa, Homo sapiens
MMMKIPWGSIPVLMLLLLLGLIDISQAQLSCTGPPAIPGIPGIPGTPGPDGQPGTPGIKGEKGLPGLAGDHGEFGEKGDPGIPGNPGKVGPKGPMGPKGGPGAPGAPGPKGESGDYKATQKIAFSATRTINVPLRRDQTIRFDHVITNMNNNYEPRSGKFTCKVPGLYYFTYHASSRGNLCVNLMRGRERAQKVVTFCDYAYNTFQVTTGGMVLKLEQGENVFLQATDKNSLLGMEGANSIFSGFLLFPDMEA

SEQ ID NO: 153 - protein, 245 aa, Homo sapiens
MDVGPSSLPHLGLKLLLLLLLLPLRGQANTGCYGIPGMPGLPGAPGKDGYDGLPGPKGEPGIPAIPGIRGPKGQKGEPGLPGHPGKNGPMGPPGMPGVPGPMGIPGEPGEEGRYKQKFQSVFTVTRQTHQPPAPNSLIRFNAVLTNPQGDYDTSTGKFTCKVPGLYYFVYHASHTANLCVLLYRSGVKVVTFCGHTSKTNQVNSGGVLLRLQVGEEVWLAVNDYYDMVGIQGSDSVFSGFLLFPD

SEQ ID NO: 154 - protein, 33 aa, Artificial Sequence
  peptide
QVIKPTFAPPVPPVKPGAGAANPGPAEGAVGPK

SEQ ID NO: 155 - protein, 27 aa, Artificial Sequence
  peptide
AICIVDVCHALTTEDGTAYEPVPEGTR

SEQ ID NO: 156 - protein, 22 aa, Artificial Sequence
  peptide
RPPPAPPVTVSSPPFPVPVYTR

SEQ ID NO: 157 - protein, 16 aa, Artificial Sequence
  peptide
TAAVFRPRPGDSLPSR

SEQ ID NO: 158 - protein, 7 aa, Artificial Sequence
  peptide
QVVDLIR

SEQ ID NO: 159 - protein, 13 aa, Artificial Sequence
  peptide
IQMLADTVATLPR

SEQ ID NO: 160 - protein, 32 aa, Artificial Sequence
  peptide
IQEDSPAHCAGLQAGDVLANINGVSTEGFTYK

SEQ ID NO: 161 - protein, 24 aa, Artificial Sequence
  peptide
YYLVHQEPLENFQCNVPLGMESGR

SEQ ID NO: 162 - protein, 10 aa, Artificial Sequence
  peptide
SGEIAIDDIR

SEQ ID NO: 163 - protein, 23 aa, Artificial Sequence
  peptide
IANEQISASSTYSDGRWTPQQSR

SEQ ID NO: 164 - protein, 10 aa, Artificial Sequence
  peptide
LISPPVHLPR

SEQ ID NO: 165 - protein, 16 aa, Artificial Sequence
  peptide
IANEQISASSTYSDGR

SEQ ID NO: 166 - protein, 13 aa, Artificial Sequence
  peptide
IRPQTWHSGIALR

SEQ ID NO: 167 - protein, 21 aa, Artificial Sequence
  peptide
IRGESELYTSDTVMQNPQFIK

SEQ ID NO: 168 - protein, 23 aa, Artificial Sequence
  peptide
VVEPGEQEHSFAFNIMEIQPFRR

SEQ ID NO: 169 - protein, 6 aa, Artificial Sequence
  peptide
WNTFLK

SEQ ID NO: 170 - protein, 22 aa, Artificial Sequence
  peptide
SVLQSINPAEPHKECPNPKPDK

SEQ ID NO: 171 - protein, 6 aa, Artificial Sequence
  peptide
IFAVWK

SEQ ID NO: 172 - protein, 13 aa, Artificial Sequence
  peptide
AAAIQTMSLDAER

SEQ ID NO: 173 - protein, 33 aa, Artificial Sequence
  peptide
GHVGQDRVDFGQTEPHTVLFHEPGSSSVWVGGR

SEQ ID NO: 174 - protein, 11 aa, Artificial Sequence
  peptide
DCENYITLLER

SEQ ID NO: 175 - protein, 18 aa, Artificial Sequence
  peptide
MQASHGETFHVLYLTTDR

SEQ ID NO: 176 - protein, 10 aa, Artificial Sequence
  peptide
ILLNYLPLER

SEQ ID NO: 177 - protein, 10 aa, Artificial Sequence
  peptide
EMIIQPGIAK

SEQ ID NO: 178 - protein, 9 aa, Artificial Sequence
  peptide
ASWTSILAK

SEQ ID NO: 179 - protein, 10 aa, Artificial Sequence
  peptide
QRELYAQFLR

SEQ ID NO: 180 - protein, 7 aa, Artificial Sequence
  peptide
ILFIYAK

SEQ ID NO: 181 - protein, 12 aa, Artificial Sequence
  peptide
SLDDSQCGITYK

SEQ ID NO: 182 - protein, 9 aa, Artificial Sequence
  peptide
FQSVFTVTR

SEQ ID NO: 183 - protein, 13 aa, Artificial Sequence
  peptide
QTHQPPAPNSLIR

SEQ ID NO: 184 - protein, 12 aa, Artificial Sequence
  peptide
TNQVNSGGVLLR

SEQ ID NO: 185 - protein, 18 aa, Artificial Sequence
  peptide
FNAVLTNPQGDYDTSTGK

SEQ ID NO: 186 - protein, 22 aa, Artificial Sequence
  peptide
FNAVLTNPQGDYDTSTGKFTCK

SEQ ID NO: 187 - protein, 11 aa, Artificial Sequence
  peptide
DQPRPAFSAIR

SEQ ID NO: 188 - protein, 13 aa, Artificial Sequence
  peptide
VGYPGPSGPLGAR

SEQ ID NO: 189 - protein, 23 aa, Artificial Sequence
  peptide
KGHIYQGSEADSVFSGFLIFPSA

SEQ ID NO: 190 - protein, 18 aa, Artificial Sequence
  peptide
GSPGNIKDQPRPAFSAIR

SEQ ID NO: 191 - protein, 9 aa, Artificial Sequence
  peptide
GNLCVNLMR

SEQ ID NO: 192 - protein, 14 aa, Artificial Sequence
  peptide
VPGLYYFTYHASSR

SEQ ID NO: 193 - protein, 20 aa, Artificial Sequence
  peptide
DQTIRFDHVITNMNNNYEPR

SEQ ID NO: 194 - protein, 15 aa, Artificial Sequence
  peptide
FDHVITNMNNNYEPR

SEQ ID NO: 195 - protein, 9 aa, Artificial Sequence
  peptide
FQSVFTVTR

SEQ ID NO: 196 - protein, 13 aa, Artificial Sequence
  peptide
QTHQPPAPNSLIR

SEQ ID NO: 197 - protein, 12 aa, Artificial Sequence
  peptide
TNQVNSGGVLLR

SEQ ID NO: 198 - protein, 18 aa, Artificial Sequence
  peptide
FNAVLTNPQGDYDTSTGK

SEQ ID NO: 199 - protein, 22 aa, Artificial Sequence
  peptide
FNAVLTNPQGDYDTSTGKFTCK

SEQ ID NO: 200 - protein, 9 aa, Artificial Sequence
  peptide
NFSNFILDK

SEQ ID NO: 201 - protein, 22 aa, Artificial Sequence
  peptide
TVGAGSLVDVMPWLQYFPNPVR

SEQ ID NO: 202 - protein, 10 aa, Artificial Sequence
  peptide
DLFQVIYNVK

SEQ ID NO: 203 - protein, 18 aa, Artificial Sequence
  peptide
AFGYVCGGEGQHQFFAIK

SEQ ID NO: 204 - protein, 13 aa, Artificial Sequence
  peptide
TGQQAEPLVVDLK

SEQ ID NO: 205 - protein, 11 aa, Artificial Sequence
  peptide
LIGIDDVPDAR

SEQ ID NO: 206 - protein, 12 aa, Artificial Sequence
  peptide
STDNAFENPFFK

SEQ ID NO: 207 - protein, 9 aa, Artificial Sequence
  peptide
SFITSIANK

SEQ ID NO: 208 - protein, 13 aa, Artificial Sequence
  peptide
SLSVNEMTLSTLK

SEQ ID NO: 209 - protein, 18 aa, Artificial Sequence
  peptide
RTTYGGVSGTAIRPIALR

SEQ ID NO: 210 - protein, 25 aa, Artificial Sequence
  peptide
DAIFQGLTQDQGFYTSKDFLPLVAK

SEQ ID NO: 211 - protein, 20 aa, Artificial Sequence
  peptide
SIEELQDWDGQSPATVSHQK

SEQ ID NO: 212 - protein, 14 aa, Artificial Sequence
  peptide
AGMCACHSPLPSIR

SEQ ID NO: 213 - protein, 8 aa, Artificial Sequence
  peptide
DFLPLVAK

SEQ ID NO: 214 - protein, 23 aa, Artificial Sequence
  peptide
RQLEETNNDYETADGGYMTLNPR

SEQ ID NO: 215 - protein, 25 aa, Artificial Sequence
  peptide
SPESDSIQWFHNGNLIPTHTQPSYR

SEQ ID NO: 216 - protein, 27 aa, Artificial Sequence
  peptide
VGAENTITYSLLMHPDALEEPDDQNRI

SEQ ID NO: 217 - protein, 23 aa, Artificial Sequence
  peptide
AVLKLEPQWINVLQEDSVTLTCR

SEQ ID NO: 218 - protein, 21 aa, Artificial Sequence
  peptide
EMGETLPEKPANPTNPDEADK

SEQ ID NO: 219 - protein, 28 aa, Artificial Sequence
  peptide
GTHSPESDSIQWFHNGNLIPTHTQPSYR

SEQ ID NO: 220 - protein, 16 aa, Artificial Sequence
  peptide
KLNQALLDLHALGSAR

SEQ ID NO: 221 - protein, 19 aa, Artificial Sequence
  peptide
TDPHLCDFLETHFLDEEVK

SEQ ID NO: 222 - protein, 7 aa, Artificial Sequence
  peptide
ALFQDIK

SEQ ID NO: 223 - protein, 15 aa, Artificial Sequence
  peptide
LGGPEAGLGEYLFER

SEQ ID NO: 224 - protein, 15 aa, Artificial Sequence
  peptide
LNQALLDLHALGSAR

SEQ ID NO: 225 - protein, 9 aa, Artificial Sequence
  peptide
VVINVPIFK

SEQ ID NO: 226 - protein, 24 aa, Artificial Sequence
  peptide
IHLDDANESDHFENIQSTNWQTMR

SEQ ID NO: 227 - protein, 11 aa, Artificial Sequence
  peptide
VVINVPIFKDK

SEQ ID NO: 228 - protein, 18 aa, Artificial Sequence
  peptide
NTPSPFIETFTEDDEASR

SEQ ID NO: 229 - protein, 14 aa, Artificial Sequence
  peptide
HGILQFLHIYHAVK

SEQ ID NO: 230 - protein, 8 aa, Artificial Sequence
  peptide
LEVLNVLR

SEQ ID NO: 231 - protein, 12 aa, Artificial Sequence
  peptide
ELPVTFFAHLQK

SEQ ID NO: 232 - protein, 14 aa, Artificial Sequence
  peptide
LIAAGGYNREECLR

SEQ ID NO: 233 - protein, 12 aa, Artificial Sequence
  peptide
LQVCGHEMLAHR

SEQ ID NO: 234 - protein, 19 aa, Artificial Sequence
  peptide
DGVGGLPTFLENSFIGSAR

SEQ ID NO: 235 - protein, 11 aa, Artificial Sequence
  peptide
DHGLEVLGLVR

SEQ ID NO: 236 - protein, 22 aa, Artificial Sequence
  peptide
EQLLEALQDLGLLQSGSISGLK

SEQ ID NO: 237 - protein, 7 aa, Artificial Sequence
  peptide
VPLYTLR

SEQ ID NO: 238 - protein, 15 aa, Artificial Sequence
  peptide
RLELGEALALGSGWR

SEQ ID NO: 239 - protein, 16 aa, Artificial Sequence
  peptide
RLTLEELLAVEAGATR

SEQ ID NO: 240 - protein, 21 aa, Artificial Sequence
  peptide
IYNEIPDINLDVPHSYSVLER

SEQ ID NO: 241 - protein, 7 aa, Artificial Sequence
  peptide
MILDLLK

SEQ ID NO: 242 - protein, 16 aa, Artificial Sequence
  peptide
AVGDGILCNTYIDSYK

SEQ ID NO: 243 - protein, 11 aa, Artificial Sequence
  peptide
STESYFIPEVR

SEQ ID NO: 244 - protein, 30 aa, Artificial Sequence
  peptide
NSNDPAVFKDNPTEDVEYQCVADNCHSHAK

SEQ ID NO: 245 - protein, 15 aa, Artificial Sequence
  peptide
APIHFTIEKLELNEK

SEQ ID NO: 246 - protein, 14 aa, Artificial Sequence
  peptide
SDSGTYICTAGIDK

SEQ ID NO: 247 - protein, 20 aa, Artificial Sequence
  peptide
QMPVEMSRPAVPLLNSNNEK

SEQ ID NO: 248 - protein, 14 aa, Artificial Sequence
  peptide
IISGIHMQTSESTK

SEQ ID NO: 249 - protein, 13 aa, Artificial Sequence
  peptide
EQEGEYYCTAFNR

SEQ ID NO: 250 - protein, 14 aa, Artificial Sequence
  peptide
SELVTVTESFSTPK

SEQ ID NO: 251 - protein, 21 aa, Artificial Sequence
  peptide
CTIQVTHLAQEFPEIIIQKDK

SEQ ID NO: 252 - protein, 16 aa, Artificial Sequence
  peptide
SNTVQIVVCEMLSQPR

SEQ ID NO: 253 - protein, 19 aa, Artificial Sequence
  peptide
CTIQVTHLAQEFPEIIIQK

SEQ ID NO: 254 - protein, 9 aa, Artificial Sequence
  peptide
APIHFTIEK

SEQ ID NO: 255 - protein, 19 aa, Artificial Sequence
  peptide
MSDPNMEANSHYGHNDDVR

SEQ ID NO: 256 - protein, 18 aa, Artificial Sequence
  peptide
AHWFEIQHIQPSPLQCNR

SEQ ID NO: 257 - protein, 11 aa, Artificial Sequence
  peptide
FFIVACDPPQK

SEQ ID NO: 258 - protein, 16 aa, Artificial Sequence
  peptide
LGIKPSINYYQVADFK

SEQ ID NO: 259 - protein, 18 aa, Artificial Sequence
  peptide
DCRDPPDYWTIHGLWPDK

SEQ ID NO: 260 - protein, 16 aa, Artificial Sequence
  peptide
SSPAVEQQLLVSGPGK

SEQ ID NO: 261 - protein, 14 aa, Artificial Sequence
  peptide
RIGPAGEVPQVPDK

The invention claimed is:

1. A method for treating a patient suffering from allergy and is undergoing allergen immunotherapy, which method comprises the steps of:
   a) administering an effective amount of an allergen immunotherapy to a patient suffering from the allergy;
   b) determining the level of expression of at least one marker protein comprising FcγRIIIa, or of an mRNA thereof, in a biological sample from the patient treated with allergen immunotherapy, said biological sample containing dendritic cells;
   c) comparing the level of expression of the at least one marker protein, or of an mRNA thereof, measured in step b) with that of a control; and
   d) based on the comparison with the control, determining if the immune response developed by the patient is shifting from a Th2 response towards a tolerogenic T cell response, Wherein the control consists of a biological sample from the patient obtained before the patient undergoes allergen immunotherapy, said biological sample containing dendritic cells, and wherein step d) is as follows:
      identifying that the immune response developed by the patient is shifting from a Th2 response towards a tolerogenic T cell response when the level of expression of the at least one marker protein comprising FcγRIIIa, or of an mRNA thereof, is higher than that of the control, and then proceeding with administering further rounds of the same allergen immunotherapy; or
      identifying that the immune response developed by the patient is not shifting from a Th2 response towards a tolerogenic T cell response when the level of expression of the at least one marker protein comprising FcγRIIIa, or of an mRNA thereof is lower than that of the control, and then stopping the allergen immunotherapy administration to the patient.

2. The method according to claim 1, wherein the immune response developed by the patient is identified as shifting from a Th2 response towards a tolerogenic T cell response when the level of expression of the at least one marker protein compri sing FcγRIIIa, or of an mRNA thereof, is higher than the control.

3. The method according to claim 1, wherein the allergen immunotherapy is a desensitization therapy.

* * * * *